(12) United States Patent
Blackwell et al.

(10) Patent No.: US 12,084,485 B2
(45) Date of Patent: Sep. 10, 2024

(54) LONG ACTING GLUCAGON LIKE POLYPEPTIDE-1 (GLP-1) RECEPTOR AGONISTS AND METHODS OF USE

(71) Applicant: Intarcia Therapeutics, Inc., Boston, MA (US)

(72) Inventors: William Blackwell, Boston, MA (US); Ved P. Srivastava, Boston, MA (US); Mark Paulik, Boston, MA (US)

(73) Assignee: I2O Therapeutics, Inc., Cambridge, MA (US)

( * ) Notice: Subject to any disclaimer, the term of this patent is extended or adjusted under 35 U.S.C. 154(b) by 0 days.

(21) Appl. No.: 17/553,381

(22) Filed: Dec. 16, 2021

(65) Prior Publication Data

US 2023/0063420 A1    Mar. 2, 2023

Related U.S. Application Data

(60) Provisional application No. 63/126,736, filed on Dec. 17, 2020.

(51) Int. Cl.

| *A61K 38/00* | (2006.01) |
| *A61K 9/00* | (2006.01) |
| *A61K 38/26* | (2006.01) |
| *A61P 1/16* | (2006.01) |
| *A61P 1/18* | (2006.01) |
| *A61P 3/04* | (2006.01) |
| *A61P 25/00* | (2006.01) |
| *C07K 14/605* | (2006.01) |

(52) U.S. Cl.
CPC .......... *C07K 14/605* (2013.01); *A61K 9/0004* (2013.01); *A61K 38/26* (2013.01); *A61P 1/16* (2018.01); *A61P 3/04* (2018.01)

(58) Field of Classification Search
None
See application file for complete search history.

(56) References Cited

U.S. PATENT DOCUMENTS

| 9,163,227 B2 * | 10/2015 | Annathur | C07K 14/50 |
| 2010/0256056 A1 | 10/2010 | Dong | |
| 2016/0220643 A1 * | 8/2016 | Haack | A61P 1/16 |
| 2016/0354305 A1 | 12/2016 | Alessi et al. | |

FOREIGN PATENT DOCUMENTS

| CN | 111333714 A | 6/2020 | |
| EP | 3 733 694 A1 | 11/2020 | |
| WO | WO 2014/056872 A1 | 4/2014 | |
| WO | WO-2017200943 A1 * | 11/2017 | ............. A61K 38/26 |

OTHER PUBLICATIONS

International Search Report and Written Opinion for International Application No. PCT/US2021/063920, mailed May 12, 2022, 16 pages.
Sunna et al., "Peptides and Peptide-based Biomaterials and their Biomedical Applications", Advances in Experimental Medicine and Biology 1030, https://doi.org./10.1007/978-3-319-66095-0, Chapter 9: Peptide Lipidation—a Synthetic Strategy to Afford Peptide Based Therapeutics, pp. 193-195 (2017).

* cited by examiner

*Primary Examiner* — Julie Ha
*Assistant Examiner* — Kristina M Hellman
(74) *Attorney, Agent, or Firm* — Brian C. Trinque; Lathrop GPM LLP

(57) ABSTRACT

This invention relates to isolated polypeptides that are long acting analogs of human GLP-1. The disclosed GLP-1 receptor agonist polypeptides have beneficial physicochemical properties relative to endogenous GLP-1 and known synthetic GLP-1 receptor agonist polypeptides, such as longer (i.e., "long-acting") elimination half-lives ($t_{1/2}$), and improved solubility and thermal stability. This invention also relates to methods of using presently disclosed GLP-1 receptor agonist polypeptides in a variety of therapeutic indications, as well as methods of producing the same. The disclosed GLP-1 receptor agonist polypeptides are particularly useful in methods of treating metabolic diseases or disorders, such as type 2 diabetes, treating obesity, and providing weight loss, and in methods of treating nonalcoholic fatty liver disease (NAFLD) and/or nonalcoholic steatohepatitis (NASH).

28 Claims, 11 Drawing Sheets

Specification includes a Sequence Listing.

LONG ACTING GLUCAGON LIKE POLYPEPTIDE-1 (GLP-1) RECEPTOR AGONISTS AND METHODS OF USE

CROSS-REFERENCE TO RELATED APPLICATIONS

This application claims the benefit of U.S. Ser. No. 63/126,736, filed Dec. 17, 2020, the disclosure of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Sep. 1, 2022, is named 724939_IOT-056_SL.txt and is 489 kilobytes in size.

FIELD

The present invention relates to compounds that are glucagon like polypeptide-1 (GLP-1) receptor agonists and methods of preparing the same. The invention also provides pharmaceutically acceptable compositions comprising compounds of the present invention and methods of using said compositions in the treatment of various disorders.

BACKGROUND

Endogenous GLP-1 is released from the gut in response to nutrient ingestion. Following food intake and digestion, carbohydrates and fats appear in the lumen of the gut, which stimulate a so-called incretin effect, the release of incretins such as GLP-1 from intestinal L-cells. GLP-1, once released, targets the pancreas where it enhances secretion of insulin in a "glucose dependent manner." In other words, this GLP-1-mediated effect upon insulin persists when glucose levels are high yet safely dissipates as glucose levels fall. GLP-1 activity thus self-regulates to reduce the risk of hypoglycemia (the condition by which glucose levels drop dangerously low). Since GLP-1 has a short elimination half-life ($t_{1/2}$) of less than five minutes, this endogenous peptide is unsuitably short-lived for use as a therapeutic.

Synthetic analogs of GLP-1 have been designed to have longer half-lives and similarly enhance secretion of insulin in a glucose dependent manner like endogenous GLP-1, for use in the treatment of type 2 diabetes and for providing weight loss.

Certain GLP-1 receptor agonists, including Bydureon® (exenatide), marketed by AstraZeneca of Cambridge, U.K.; Trulicity® (dulaglutide), marketed by Eli Lilly and Co., of Indianapolis, IN, U.S.A.; and Victoza® (liraglutide), Ozempic® (injectable semaglutide) & Rybelsus® (orally administered semaglutide), marketed by Novo Nordisk A/S of Bagsvaerd, Denmark, have each been approved by numerous regulatory authorities, including the United States Food and Drug Administration (U.S. FDA) and European Medicines Agency (EMA) for the treatment of patients suffering from type 2 diabetes. These marketed GLP-1 receptor agonists were developed and formulated for injectable and/or oral administration to patients. However, patient adherence to injectable and orally administered therapies for type 2 diabetes is notoriously poor which prohibits many patients from realizing a full and lasting therapeutic potential of GLP-1 receptor agonists. Many patients skip or cease periodic self-administrations of prescribed injectable and orally administered GLP-1 receptor agonists and thus fail to adequately treat and control their own type 2 diabetic condition.

Accordingly, there remains a need for improved GLP-1 receptor agonist polypeptides with high potencies against the GLP-1 receptor, having excellent physicochemical properties, and that are tailored for delivery to patients via more reliable modes of administration than injectable and orally administered therapies.

SUMMARY

It has now been found that compounds of this invention, and pharmaceutically acceptable compositions thereof, are effective as GLP-1 receptor agonists. Such compounds have a general formula as follows:

An isolated polypeptide, comprising the amino acid sequence of SEQ ID NO: 200:

$HX_2X_3GTX_6X_7X_8X_9X_{10}SX_{12}X_{13}X_{14}EX_{16}X_{17}X_{18}$ $X_{19}X_{20}X_{21}FIX_{24}WLKX_{28}GGPX_{32}SGAPP$ PS-(OH/$NH_2$) (SEQ ID NO: 200);

wherein each variable is as defined and described herein.

Compounds of the present invention have been designed to attain long elimination half-lives ($t_{1/2}$) and are thus described herein as "long-acting" GLP-1 receptor agonists.

Compounds of the present invention, and pharmaceutically acceptable compositions thereof, are useful for treating a variety of diseases, disorders or conditions, associated with the GLP-1 receptor. Such diseases, disorders, or conditions include metabolic diseases or disorders such as type 2 diabetes, obesity and the need to attain weight loss. In certain embodiments, the invention also relates to methods of treating nonalcoholic fatty liver disease (NAFLD) and/or nonalcoholic steatohepatitis (NASH).

BRIEF DESCRIPTION OF THE DRAWINGS

FIG. 3 depicts a cross-sectional diagram of a representative osmotic mini-pump for drug delivery.

DETAILED DESCRIPTION

Figure 1:
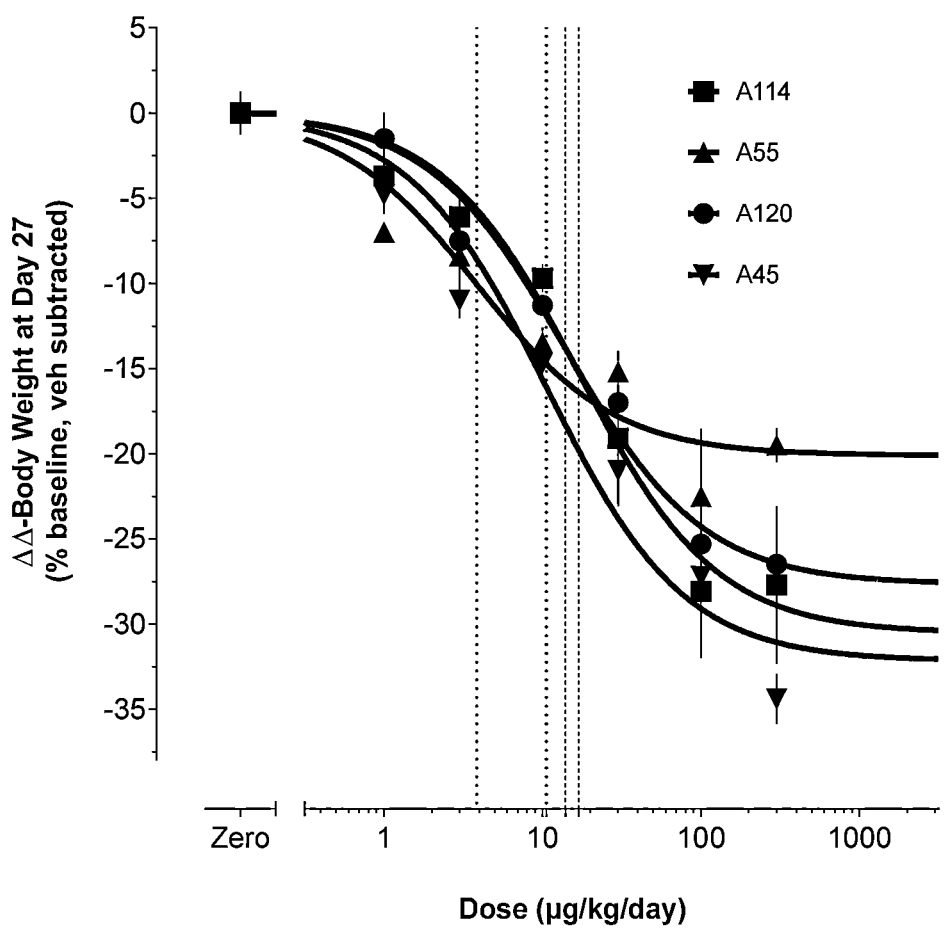
FIG. 1 depicts chronic weight loss (Day 27) in Long Evans (LE) diet-induced obese (DIO) rats treated with exemplary long acting GLP-1 analog polypeptides.

General Description of Certain Embodiments of the Invention

Compounds of the present invention, and pharmaceutical compositions thereof, are useful as agonists of the GLP-1 receptor, particularly as agonists of the human GLP-1 receptor. This invention also relates to methods of producing and using such compounds, i.e., GLP-1 receptor agonist polypeptides. Compounds of the present invention are long-acting GLP-1 receptor agonists. These GLP-1 receptor agonist polypeptides are particularly useful in methods of treating metabolic diseases or disorders, such as type 2 diabetes, obesity, and in methods of providing weight loss. In certain embodiments, the invention also relates to methods of treating nonalcoholic fatty liver disease (NAFLD) and/or nonalcoholic steatohepatitis (NASH).

In certain embodiments, the present invention provides an isolated polypeptide, comprising the amino acid sequence of SEQ ID NO: 200: $HX_2X_3GTX_6X_7X_8X_9X_{10}SX_{12}X_{13}X_{14}EX_{16}X_{17}X_{18}X_{19}X_{20}X_{21}FIX_{24}WLKX_{28}GGPX_{32}SGAPPPS-(OH/NH_2)$ (SEQ ID NO: 200) or a pharmaceutically acceptable salt thereof, wherein:

$X_2$ is A, 2-aminoisobutyric acid (Aib), or G;
$X_3$ is E or N-methyl Glu;
$X_6$ is F or Y;
$X_7$ is S or T;
$X_8$ is diaminopimelic acid (Dap), E, K, N, N-methyl Ser, Q, S, s, or Y;
$X_9$ is D or E;
$X_{10}$ is I, L, N-methyl Leu, or V;
$X_{12}$ is E, K, Q, or S;
$X_{13}$ is Aib, E, K, Q, S, W, or Y;
$X_{14}$ is E, R, I, K, L, M, Q, or Y;
$X_{16}$ is 2,4-diaminobutanoic acid (Dab), Dap, E, K, k, or ornithine (Orn);
$X_{17}$ is E, K, or Q;
$X_{18}$ is A, K, S, or Y;
$X_{19}$ is A, K, or V;
$X_{20}$ is E, K, or R;
$X_{21}$ is Aib, E, H, K, L, Q, or Y;
$X_{24}$ is A, Aib, E, K, Q, S, or Y;
$X_{28}$ is D, E, K, N, Q, S, or Y; and
$X_{32}$ is Dap, H, K, R, or S;
wherein when $X_{16}$ is Dab, Dap, K, k, or Orn, it is covalently bound to a lipophilic substituent, optionally via a spacer;

wherein when $X_{16}$ is E, at least one of $X_{14}$, $X_{17}$, $X_{18}$, $X_{19}$, $X_{20}$, or $X_{21}$ is selected to be lysine wherein the lysine residue is covalently bound to a lipophilic substituent, optionally via a spacer; and wherein the isolated polypeptide optionally further comprises two amino acid residues having side chains that are covalently joined to form a bridging moiety.

In some embodiments, the bridging moiety is a lactam bridging moiety. For example, in some embodiments, the isolated polypeptide optionally further comprises two amino acid residues, wherein one is lysine and the other is glutamic acid, and the amino-containing sidechain of lysine and the carboxy-containing sidechain of glutamic acid are covalently joined, with loss of water, to form a lactam bridging moiety. In some embodiments, the lactam bridging moiety is formed via covalent bonds between side chains of a lysine and a glutamic acid at positions $X_{17}$ and $X_{21}$, respectively; at positions $X_{21}$ and $X_{17}$, respectively; at positions $X_{21}$ and $X_{28}$, respectively; at positions $X_{28}$ and $X_{21}$, respectively; at positions $X_{20}$ and $X_{24}$, respectively; at positions $X_{24}$ and $X_{20}$, respectively; or at positions $X_{12}$ and $X_{16}$, respectively.

In one embodiment, the isolated polypeptide is not an analogue of exenatide, HGEGTFTSDLSKQMEEE-AVRLFIEWLKNGGPSSGAPPPS-NH$_2$ (SEQ ID NO: 300), having $K_{12}$ or $K_{27}$ covalently bound to a lipophilic substituent, optionally via a spacer.

In some embodiments, $X_2$ is Aib.
In some embodiments, if $X_{24}$ is S, then $X_{10}$ is V.
In some embodiments, $X_{14}$ is Y.
In some embodiments, $X_{14}$ is M, and $X_{16}$ is K covalently bound to a lipophilic substituent, optionally via a spacer.
In some embodiments, $X_{16}$ is lysine covalently bound to a lipophilic substituent, optionally via a spacer.
In some embodiments, if $X_{16}$ is E, then $X_{21}$ is K or E. In some embodiments, if $X_{16}$ is E, then $X_{21}$ is K. In some embodiments, if $X_{16}$ is E, then $X_{21}$ is E.

In some embodiments, the peptide further comprises a lactam bridge formed via an amide bond between the side chains of a lysine and a glutamic acid at positions $X_{20}$ and $X_{24}$, respectively.

Definitions

It is to be understood that the terminology used herein is for the purpose of describing particular embodiments only, and is not intended to be limiting. As used in this specification and the appended claims, the singular forms "a," "an" and "the" include plural referents unless the context clearly dictates otherwise. Thus, for example, reference to "a solvent" includes a combination of two or more such solvents, reference to "a peptide" includes one or more peptides, or mixtures of peptides, reference to "a drug" includes one or more drugs, reference to "an osmotic delivery device" includes one or more osmotic delivery devices, and the like. Unless specifically stated or obvious from context, as used herein, the term "or" is understood to be inclusive and covers both "or" and "and".

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from the context, all numerical values provided herein are modified by the term "about."

Unless specifically stated or obvious from context, as used herein, the term "substantially" is understood as within a narrow range of variation or otherwise normal tolerance in the art. Substantially can be understood as within 5%, 4%, 3%, 2%, 1%, 0.5%, 0.1%, 0.05%, 0.01% or 0.001% of the stated value.

Unless defined otherwise, all technical and scientific terms used herein have the same meaning as commonly understood by one of ordinary skill in the art to which the invention pertains. Although other methods and materials similar, or equivalent, to those described herein can be used in the practice of the present invention, the preferred materials and methods are described herein.

In describing and claiming the present invention, the following terminology will be used in accordance with the definitions set out below.

The terms "drug," "therapeutic agent," and "beneficial agent" are used interchangeably to refer to any therapeutically active substance that is delivered to a subject to produce a desired beneficial effect. In one embodiment of the present invention, the drug is a polypeptide. In another embodiment of the present invention, the drug is a small molecule, for example, hormones such as androgens or estrogens. The devices and methods of the present invention are well suited for the delivery of proteins, small molecules and combinations thereof.

The terms "peptide," "polypeptide," and "protein" are used interchangeably herein and typically refer to a molecule comprising a chain of two or more amino acids (e.g., most typically L-amino acids, but also including, e.g., D-amino acids, modified amino acids, amino acid analogs, and amino acid mimetics).

In some embodiments, naturally-occurring L-amino acids, are represented by either conventional three-letter, or capitalized one-letter, amino acid designations of Table 1. In other embodiments, naturally-occurring L-amino acids and D-amino acids, are both represented by either conventional three-letter, or capitalized one-letter, amino acid designations of Table 1. In still other embodiments, D-amino acids, are represented by lower-case one-letter amino acid designations corresponding to one-letter designations of Table 2, i.e., a, l, m, f, w, k, q, e, s, p, v, i, c, y, h, r, n, d, and t.

TABLE 1

Naturally-occurring amino acids

| G | Glycine | Gly | P | Proline | Pro |
|---|---|---|---|---|---|
| A | Alanine | Ala | V | Valine | Val |
| L | Leucine | Leu | I | Isoleucine | Ile |
| M | Methionine | Met | C | Cysteine | Cys |
| F | Phenylalanine | Phe | Y | Tyrosine | Tyr |
| W | Tryptophan | Trp | H | Histidine | His |
| K | Lysine | Lys | R | Arginine | Arg |
| Q | Glutamine | Gln | N | Asparagine | Asn |
| E | Glutamic Acid | Glu | D | Aspartic Acid | Asp |
| S | Serine | Ser | T | Threonine | Thr |

TABLE 2

Lower case designations refer to D stereoisomers of amino acids

| | | | p | Proline | D-Pro |
|---|---|---|---|---|---|
| a | D-Alanine | D-Ala | v | D-Valine | D-Val |
| l | D-Leucine | D-Leu | i | D-Isoleucine | D-Ile |
| m | D-Methionine | D-Met | c | D-Cysteine | D-Cys |
| f | D-Phenylalanine | D-Phe | y | D-Tyrosine | D-Tyr |
| w | D-Tryptophan | D-Trp | h | D-Histidine | D-His |
| k | D-Lysine | D-Lys | r | D-Arginine | D-Arg |
| q | D-Glutamine | D-Gln | n | D-Asparagine | D-Asn |
| e | D-Glutamic Acid | D-Glu | d | D-Aspartic Acid | D-Asp |
| s | D-Serine | D-Ser | t | D-Threonine | D-Thr |

Peptides may be naturally occurring, synthetically produced, or recombinantly expressed. Peptides may also comprise additional groups modifying the amino acid chain, for example, functional groups added via post-translational modification. Examples of post-translation modifications include, but are not limited to, acetylation, alkylation (including, methylation), biotinylation, glutamylation, glycylation, glycosylation, isoprenylation, lipoylation, phosphopantetheinylation, phosphorylation, selenation, and C-terminal amidation. The term peptide also includes peptides comprising modifications of the amino terminus and/or the carboxy terminus. Modifications of the terminal amino group include, but are not limited to, des-amino, N-lower alkyl, N-di-lower alkyl, and N-acyl modifications. Modifications of the terminal carboxy group include, but are not limited to, amide, lower alkyl amide, dialkyl amide, and lower alkyl ester modifications (e.g., wherein lower alkyl is $C_1$-$C_4$ alkyl). The term peptide also includes modifications, such as but not limited to those described above, of amino acids falling between the amino and carboxy termini. In one embodiment, a peptide may be modified by addition of a small-molecule drug.

The terminal amino acid at one end of the peptide chain typically has a free amino group (i.e., the amino terminus). The terminal amino acid at the other end of the chain typically has a free carboxyl group (i.e., the carboxy terminus). Typically, the amino acids making up a peptide are numbered in order, starting at the amino terminus and increasing in the direction of the carboxy terminus of the peptide.

The phrase "amino acid residue" as used herein refers to an amino acid that is incorporated into a peptide by an amide bond or an amide bond mimetic.

The term "insulinotropic" as used herein typically refers to the ability of a compound, e.g., a peptide, to stimulate or affect the production and/or activity of insulin (e.g., an insulinotropic hormone). Such compounds typically stimulate or otherwise affect the secretion or biosynthesis of insulin in a subject. Thus, an "insulinotropic peptide" is an amino acid-containing molecule capable of stimulating or otherwise affecting secretion or biosynthesis of insulin.

The term "insulinotropic peptide" as used herein includes, but is not limited to, glucagon-like peptide 1 (GLP-1), as well as derivatives and analogues thereof, GLP-1 receptor agonists, such as exenatide, exenatide having the amino acid sequence of SEQ ID NO: 300, as well as derivatives and analogues thereof.

The term "acylated" as used herein, in relation to disclosed polypeptides, means the disclosed polypeptide is substituted with one or more lipophilic substituents each optionally via a spacer, wherein "lipophilic substituent" and "spacer" are defined herein. Certain lipophilic substituents, each optionally via a spacer, can bind albumin and confer affinity to albumin to the resulting acylated polypeptide. The extent is variable, and depending on numerous factors, to which lipophilic substituents, each optionally via a spacer, bind albumin and confer affinity to albumin to the resulting acylated polypeptide. Numerous factors include identities of the lipophilic substituent, optional spacer, polypeptide, and the site of covalent attachment to the polypeptide.

The terms "linear" or "liner polypeptide" as used herein, refer to a "non-acylated" polypeptide, in other words, a disclosed GLP-1 receptor agonist polypeptide without a lipophilic substituents each optionally via a spacer, wherein "lipophilic substituent" and "spacer" are defined herein.

The terms "conjugated" or conjugated polypeptide" as used herein, refer to an "acylated" polypeptide, in other words, a disclosed GLP-1 receptor agonist polypeptide having one or more lipophilic substituents each optionally via a spacer, wherein "lipophilic substituent" and "spacer" are defined herein.

As used herein, the term "pharmaceutically acceptable salts" refers to derivatives of the disclosed polypeptides wherein the parent polypeptide is modified by converting an existing acid or base moiety to its salt form. Lists of suitable salts are found in Remington's Pharmaceutical Sciences, 17th ed., Mack Publishing Company, Easton, Pa., 1985, p. 1418 and Journal of Pharmaceutical Science, 66, 2 (1977), each of which is incorporated herein by reference in its entirety.

The term "vehicle" as used herein refers to a medium used to carry a compound, e.g., a drug or a particle containing a drug. Vehicles of the present invention typically comprise components such as polymers and solvents. The suspension vehicles of the present invention typically comprise solvents and polymers that are used to prepare suspension formulations further comprising drug particle formulations.

The phrase "phase separation" as used herein refers to the formation of multiple phases (e.g., liquid and gel phases) in the suspension vehicle, such as when the suspension vehicle contacts the aqueous environment. In some embodiments of the present invention, the suspension vehicle is formulated to exhibit phase separation upon contact with an aqueous environment having less than approximately 10% water.

The phrase "single-phase" as used herein refers to a solid, semisolid, or liquid homogeneous system that is physically and chemically uniform throughout.

The term "dispersed" as used herein refers to dissolving, dispersing, suspending, or otherwise distributing a compound, for example, a drug particle formulation, in a suspension vehicle.

The phrase "chemically stable" as used herein refers to formation in a formulation of an acceptable percentage of degradation products produced over a defined period of time by chemical pathways, such as deamidation (usually by hydrolysis), aggregation, or oxidation.

The phrase "physically stable" as used herein refers to formation in a formulation of an acceptable percentage of aggregates (e.g., dimers and other higher molecular weight products). Further, a physically stable formulation does not change its physical state as, for example, from liquid to solid, or from amorphous to crystal form.

The term "viscosity" as used herein typically refers to a value determined from the ratio of shear stress to shear rate (see, e.g., Considine, D. M. & Considine, G. D., Encyclopedia of Chemistry, 4th Edition, Van Nostrand, Reinhold, N.Y., 1984) essentially as follows:

$$F/A = \mu * V/L \quad \text{(Equation 1)}$$

where F/A=shear stress (force per unit area),
$\mu$=a proportionality constant (viscosity), and
V/L=the velocity per layer thickness (shear rate).

From this relationship, the ratio of shear stress to shear rate defines viscosity. Measurements of shear stress and shear rate are typically determined using parallel plate rheometry performed under selected conditions (for example, a temperature of about 37° C.). Other methods for the determination of viscosity include, measurement of a kinematic viscosity using viscometers, for example, a Cannon-Fenske viscometer, an Ubbelohde viscometer for the Cannon-Fenske opaque solution, or a Ostwald viscometer. Generally, suspension vehicles of the present invention have a viscosity sufficient to prevent a particle formulation suspended therein from settling during storage and use in a method of delivery, for example, in an implantable, drug delivery device.

The term "non-aqueous" as used herein refers to an overall moisture content, for example, of a suspension formulation, typically of less than or equal to about 10 wt %, for example, less than or equal to about 7 wt %, less than or equal to about 5 wt %, and/or less than about 4 wt %. Also, a particle formulation of the present invention comprises less than about 10 wt %, for example, less than about 5 wt %, residual moisture.

The term "subject" as used herein refers to any member of the subphylum Chordata, including, without limitation, humans and other primates, including non-human primates such as rhesus macaques and other monkey species and chimpanzees and other ape species; farm animals such as cattle, sheep, pigs, goats and horses; domestic mammals such as dogs and cats; laboratory animals including rodents such as mice, rats and guinea pigs; birds, including domestic, wild and game birds such as chickens, turkeys and other gallinaceous birds, ducks, geese, and the like. The term does not denote a particular age or gender. Thus, both adult and newborn individuals are intended to be covered.

As used herein, the terms "treatment," "treat," and "treating" refer to reversing, alleviating, delaying the onset of, or inhibiting the progress of a disease or disorder, or one or more symptoms thereof, as described herein. In some embodiments, treatment may be administered after one or more symptoms have developed. In other embodiments, treatment may be administered in the absence of symptoms. For example, treatment may be administered to a susceptible individual prior to the onset of symptoms (e.g., in light of a history of symptoms and/or in light of genetic or other susceptibility factors). Treatment may also be continued after symptoms have resolved, for example to prevent or delay their recurrence.

The term "osmotic delivery device" as used herein typically refers to a device used for delivery of a drug (e.g., a disclosed GLP-1 receptor agonist polypeptide) to a subject, wherein the device comprises, for example, a reservoir (made, e.g., from a titanium alloy) having a lumen that contains a suspension formulation comprising a drug (e.g., a disclosed GLP-1 receptor agonist polypeptide) and an osmotic agent formulation. A piston assembly positioned in the lumen isolates the suspension formulation from the osmotic agent formulation. A semi-permeable membrane is positioned at a first distal end of the reservoir adjacent the osmotic agent formulation and a diffusion moderator (which defines a delivery orifice through which the suspension formulation exits the device) is positioned at a second distal end of the reservoir adjacent the suspension formulation. Typically, the osmotic delivery device is implanted within the subject, for example, subdermally or subcutaneously (e.g., in the inside, outside, or back of the upper arm and in the abdominal area). An exemplary osmotic delivery device is the DUROS® (ALZA Corporation, Mountain View, Calif.) delivery device. Examples of terms synonymous to "osmotic delivery device" include but are not limited to "osmotic drug delivery device", "osmotic drug delivery system", "osmotic device", "osmotic delivery device", "osmotic delivery system", "osmotic pump", "implantable drug delivery device", "drug delivery system", "drug delivery device", "implantable osmotic pump", "implantable drug delivery system", and "implantable delivery system". Other terms for "osmotic delivery device" are known in the art.

The term "continuous delivery" as used herein typically refers to a substantially continuous release of drug from an osmotic delivery device and into tissues near the implantation site, e.g., subdermal and subcutaneous tissues. For example, an osmotic delivery device releases drug essentially at a predetermined rate based on the principle of osmosis. Extracellular fluid enters the osmotic delivery device through the semi-permeable membrane directly into the osmotic engine that expands to drive the piston at a slow and consistent rate of travel. Movement of the piston forces the drug formulation to be released through the orifice of the diffusion moderator. Thus, release of the drug from the osmotic delivery device is at a slow, controlled, consistent rate.

The term "substantial steady-state delivery" as used herein typically refers to delivery of a drug at or near a target concentration over a defined period of time, wherein the amount of the drug being delivered from an osmotic delivery device is substantially zero-order delivery. Substantial zero-order delivery of an active agent (e.g., a disclosed GLP-1 receptor agonist polypeptide) means that the rate of drug delivered is constant and is independent of the drug available in the delivery system; for example, for zero-order delivery, if the rate of drug delivered is graphed against time and a line is fitted to the data the line has a slope of approximately zero, as determined by standard methods (e.g., linear regression).

The phrase "drug half-life" as used herein refers how long it takes a drug to be eliminated from blood plasma by one half of its concentration. A drug's half-life is usually measured by monitoring how a drug degrades when it is administered via injection or intravenously. A drug is usually detected using, for example, a radioimmunoassay (RIA), a chromatographic method, an electrochemiluminescent (ECL) assay, an enzyme linked immunosorbent assay (ELISA) or an immunoenzymatic sandwich assay (IEMA).

The terms "µg" and "mcg" and "ug" are understood to mean "micrograms". Similarly, the terms "µl" and "uL" are understood to mean "microliter", and the terms "µM" and "uM" are understood to mean "micromolar".

The term "serum" is meant to mean any blood product from which a substance can be detected. Thus, the term serum includes at least whole blood, serum, and plasma. For example, "an amount of [a substance] in a subject's serum" would cover "an amount of [the substance] in a subject's plasma".

Baseline is defined as the last assessment on or before the day of the initial placement of an osmotic delivery device (containing drug or placebo).

Endogenous GLP-1, GLP-1 Receptors, and Certain GPL-1 Analogs

The phrase "incretin mimetics" as used herein includes, but is not limited to

GLP-1 peptide, GLP-1 (7-36), GLP-1 receptor agonists, peptide derivatives of GLP-1, peptide analogs of GLP-1, exenatide, exenatide having the amino acid sequence of exendin-4 (the naturally-occurring form of exenatide, exenatide-LAR, lixisenatide, liraglutide, semaglutide, dulaglutide, albiglutide, and taspoglutide. Incretin mimetics are also referred to herein as "insulinotropic peptides." Incretin mimetics which target the GLP-1 receptor are also known in the literature as "GLP-1 receptor agonists" or "GLP-1 agonists," with both terms being used interchangeably herein.

The term "GLP-1" refers to a polypeptide, glucagon-like peptide-1(7-36)amide, a 30-residue peptide hormone released from intestinal L cells following nutrient consumption. GLP-1 has the amino acid sequence of (HAE-GTFTSDVSSYLEGQAAKEFIAWLVKGR-NH$_2$), SEQ ID NO: 301. GLP-1 is a regulatory peptide that binds to the extracellular region of the GLP-1 receptor (GLP-1R), a G-coupled protein receptor on β cell and via adenyl cyclase activity and production of cAMP stimulates the insulin response to the nutrients that are absorbed from the gut [Baggio 2007, "Biology of incretins: GLP-1 and GIP," Gastroenterology, vol. 132(6):2131-57; Holst 2008, "The incretin system and its role in type 2 diabetes mellitus," Mol Cell Endocrinology, vol. 297(1 2):127-36]. The effects of GLP-1R agonism are multiple. GLP-1 maintains glucose homeostasis by enhancing endogenous glucose dependent insulin secretion, rendering the β cells glucose competent and sensitive to GLP-1, suppressing glucagon release, restoring first and second phase insulin secretion, slowing gastric emptying, decreasing food intake, and increasing satiety [Holst 2008 Mol. Cell Endocrinology; Kjems 2003 "The influence of GLP-1 on glucose-stimulated insulin secretion: effects on beta-cell sensitivity in type 2 and nondiabetic subjects," Diabetes, vol. 52(2): 380-86; Holst 2013 "Incretin hormones and the satiation signal," Int J Obes (Lond), vol. 37(9):1161-69; Seufert 2014, "The extra-pancreatic effects of GLP-1 receptor agonists: a focus on the cardiovascular, gastrointestinal and central nervous systems," Diabetes Obes Metab, vol. 16(8): 673-88]. The risk of hypoglycemia is minimal given the mode of action of GLP-1. Glucagon-like peptide-1(7-36)amide (GLP-1) is a 30-residue peptide hormone released from intestinal L cells following nutrient consumption. It potentiates the glucose-induced secretion of insulin from pancreatic beta cells, increases insulin expression, inhibits beta-cell apoptosis, promotes beta-cell neogenesis, reduces glucagon secretion, delays gastric emptying, promotes satiety and increases peripheral glucose disposal. These multiple effects have generated a great deal of interest in the discovery of long-lasting agonists of the GLP-1 receptor (GLP-1R) in order to treat type 2 diabetes. The term "exenatide" as used herein includes, but is not limited to exenatide, exenatide having the amino acid sequence of (HGEGTFTSDLSKQMEEE-AVRLFIEWLKNGGPSSGAPPPS-NH$_2$), SEQ ID NO: 300, native exendin-4, exenatide peptides, exenatide peptide analogs, and exenatide peptide derivatives.

Certain disclosed GLP-1 receptor agonist polypeptides, including those of Table 4 below, exhibit one or more of: excellent solubility, stability, bioavailability, biological activity and specificity, and longer half-lives than those for endogenous GLP-1 and known GLP-1 receptor agonists. Certain disclosed GLP-1 receptor agonist polypeptides were developed to accommodate less frequent administration than is required for presently marketed GLP-1 receptor agonists. Certain disclosed GLP-1 receptor agonist polypeptides were developed for administration via weekly or monthly injections. Certain disclosed GLP-1 receptor agonist polypeptides were developed for administration via implantation of a delivery device comprising the GLP-1 receptor agonist polypeptide, where the delivery device comprises a dose of the GLP-1 receptor agonist polypeptide of up to 3 months, 6 months, 9 months, one year, 18 months or two years.

DESCRIPTION OF EXEMPLARY EMBODIMENTS

In certain embodiments, the present invention provides an isolated polypeptide, comprising the amino acid sequence of SEQ ID NO: 210: $HX_2X_3GTX_6X_7X_8X_9X_{10}SX_{12}X_{13}X_{14}EX_{16}X_{17}X_{18}X_{19}X_{20}X_{21}FIX_{24}WLKX_{28}G$ $GPX_{32}SGAPPPS\text{-}(OH/NH_2)$ (SEQ ID NO: 210) or a pharmaceutically acceptable salt thereof, wherein:

$X_2$ is A, 2-aminoisobutyric acid (Aib), or G;
$X_3$ is E or N-methyl Glu;
$X_6$ is F or Y;
$X_7$ is S or T;
$X_8$ is diaminopimelic acid (Dap), E, K, N, N-methyl Ser, Q, S, s, or Y;
$X_9$ is D or E;
$X_{10}$ is I, L, N-methyl Leu, or V;
$X_{12}$ is E, K, Q, or S;
$X_{13}$ is Aib, E, K, Q, S, W, or Y;
$X_{14}$ is E, R, I, K, L, M, Q, or Y;
$X_{16}$ is 2,4-diaminobutanoic acid (Dab), Dap, E, K, k, or ornithine (Orn);
$X_{17}$ is E, K, or Q;
$X_{18}$ is A, K, S, or Y;
$X_{19}$ is A, K, or V;
$X_{20}$ is E, K, or R;
$X_{21}$ is Aib, E, H, K, L, Q, or Y;
$X_{24}$ is A, Aib, E, K, Q, S, or Y;
$X_{28}$ is D, E, K, N, Q, S, or Y; and
$X_{32}$ is Dap, H, K, R, or S;
with the proviso that the isolated polypeptide is not exenatide.

In some embodiments, $X_2$ is Aib.
In some embodiments, if $X_{24}$ is S, then $X_{10}$ is V.
In some embodiments, $X_{14}$ is Y.
In some embodiments, $X_{14}$ is M, and $X_{16}$ is K.
In some embodiments, $X_{16}$ is K.
In some embodiments, if $X_{16}$ is E, then $X_{21}$ is K or E. In some embodiments, if $X_{16}$ is E, then $X_{21}$ is K. In some embodiments, if $X_{16}$ is E, then $X_{21}$ is E.
In some embodiments, $X_2$ is A. In some embodiments, $X_2$ is Aib. In some embodiments, $X_2$ is G.

As used herein, Aib refers alternatively to 2-aminoisobutyric acid, α-aminoisobutyric acid, α-methylalanine or 2-methylalanine.

In some embodiments, $X_3$ is E. In some embodiments, $X_3$ is N-methyl Glu.
In some embodiments, $X_6$ is F. In some embodiments, $X_6$ is Y.
In some embodiments, $X_7$ is S. In some embodiments, $X_7$ is T.
In some embodiments, $X_8$ is Dap. In some embodiments, $X_8$ is E. In some embodiments, $X_8$ is K. In some embodiments, $X_8$ is N. In some embodiments, $X_8$ is N-methyl Ser. In some embodiments, $X_8$ is Q. In some embodiments, $X_8$ is S. In some embodiments, $X_8$ is s. In some embodiments, $X_8$ is Y.

As used herein, Dap refers to diaminopimelic acid.
As used herein, s refers to D-serine.
In some embodiments, $X_9$ is D. In some embodiments, $X_9$ is E.
In some embodiments, $X_{10}$ is I. In some embodiments, $X_{10}$ is L. In some embodiments, $X_{10}$ is N-methyl Leu. In some embodiments, $X_{10}$ is V.

In some embodiments, $X_{12}$ is E. In some embodiments, $X_{12}$ is K. In some embodiments, $X_{12}$ is Q. In some embodiments, $X_{12}$ is S.
In some embodiments, $X_{13}$ is Aib. In some embodiments, $X_{13}$ is E. In some embodiments, $X_{13}$ is K. In some embodiments, $X_{13}$ is Q. In some embodiments, $X_{13}$ is S. In some embodiments, $X_{13}$ is W. In some embodiments, $X_{13}$ is Y.
In some embodiments, $X_{14}$ is E. In some embodiments, $X_{14}$ is R. In some embodiments, $X_{14}$ is I. In some embodiments, $X_{14}$ is K. In some embodiments, $X_{14}$ is L. In some embodiments, $X_{14}$ is M. In some embodiments, $X_{14}$ is Q. In some embodiments, $X_{14}$ is Y.
In some embodiments, $X_{16}$ is Dab. In some embodiments, $X_{16}$ is Dap. In some embodiments, $X_{16}$ is E. In some embodiments, $X_{16}$ is K. In some embodiments, $X_{16}$ is k. In some embodiments, $X_{16}$ is Orn.

As used herein, Dab refers alternately to 2,4-diaminobutanoic acid, 2,4-diaminobutyric acid, or α,γ-diaminobutyric acid.
As used herein, k refers to D-lysine.
As used herein, Orn refers to ornithine.

In some embodiments, $X_{17}$ is E. In some embodiments, $X_{17}$ is K. In some embodiments, $X_{17}$ is Q.
In some embodiments, $X_{18}$ is A. In some embodiments, $X_{18}$ is K. In some embodiments, $X_{18}$ is S. In some embodiments, $X_{18}$ is Y.
In some embodiments, $X_{19}$ is A. In some embodiments, $X_{19}$ is K. In some embodiments, $X_{19}$ is V.
In some embodiments, $X_{20}$ is E. In some embodiments, $X_{20}$ is K. In some embodiments, $X_{20}$ is R.
In some embodiments, $X_{21}$ is Aib. In some embodiments, $X_{21}$ is E. In some embodiments, $X_{21}$ is H. In some embodiments, $X_{21}$ is K. In some embodiments, $X_{21}$ is L. In some embodiments, $X_{21}$ is Q. In some embodiments, $X_{21}$ is Y.
In some embodiments, $X_{24}$ is A. In some embodiments, $X_{24}$ is Aib. In some embodiments, $X_{24}$ is E. In some embodiments, $X_{24}$ is K. In some embodiments, $X_{24}$ is Q. In some embodiments, $X_{24}$ is S. In some embodiments, $X_{24}$ is Y.
In some embodiments, $X_{28}$ is D. In some embodiments, $X_{28}$ is E. In some embodiments, $X_{28}$ is K. In some embodiments, $X_{28}$ is N. In some embodiments, $X_{28}$ is Q. In some embodiments, $X_{28}$ is S. In some embodiments, $X_{28}$ is Y.
In some embodiments, $X_{32}$ is Dap. In some embodiments, $X_{32}$ is H. In some embodiments, $X_{32}$ is K. In some embodiments, $X_{32}$ is R. In some embodiments, $X_{32}$ is S.

In some embodiments, carboxy terminal amino acid, i.e. $S_{39}$, is $—S_{39}—(NH_2)$. In some embodiments, carboxy terminal amino acid $S_{39}$ is $—S_{39}—(OH)$.

In some embodiments, certain amino acids represented by the consensus sequence of SEQ ID NO: 210 include the following:

In some embodiments, $X_2$ is Aib and $X_{10}$ is V. In some embodiments, $X_2$ is Aib and $X_{14}$ is Y. In some embodiments, $X_2$ is Aib and $X_{16}$ is K. In some embodiments, $X_2$ is Aib and $X_{19}$ is V. In some embodiments, $X_2$ is Aib and $X_{19}$ is A. In some embodiments, $X_2$ is Aib and $X_{20}$ is R. In some embodiments, $X_2$ is Aib and $X_{20}$ is K. In some embodiments, $X_2$ is Aib and $X_{21}$ is K. In some embodiments, $X_2$ is Aib and $X_{21}$ is Q. In some embodiments, $X_2$ is Aib and $X_{24}$ is S. In some embodiments, $X_2$ is Aib and $X_{24}$ is E.

In some embodiments, $X_{10}$ is V and $X_{14}$ is Y. In some embodiments, $X_{10}$ is V and $X_{16}$ is K. In some embodiments, $X_{10}$ is V and $X_{19}$ is V. In some embodiments, $X_{10}$ is V and $X_{19}$ is A. In some embodiments, $X_{10}$ is V and $X_{20}$ is R. In some embodiments, $X_{10}$ is V and $X_{20}$ is K. In some embodiments, $X_{10}$ is V and $X_{21}$ is K. In some embodiments, $X_{10}$ is V and $X_{21}$ is Q. In some embodiments, $X_{10}$ is V and $X_{24}$ is S. In some embodiments, $X_{10}$ is V and $X_{24}$ is E.

In some embodiments, $X_{14}$ is Y and $X_{16}$ is K. In some embodiments, $X_{14}$ is Y and $X_{19}$ is V. In some embodiments, $X_{14}$ is Y and $X_{19}$ is A. In some embodiments, $X_{14}$ is Y and $X_{20}$ is R. In some embodiments, $X_{14}$ is Y and $X_{20}$ is K. In some embodiments, $X_{14}$ is Y and $X_{21}$ is K. In some embodiments, $X_{14}$ is Y and $X_{21}$ is Q. In some embodiments, $X_{14}$ is Y and $X_{24}$ is S. In some embodiments, $X_{14}$ is Y and $X_{24}$ is E.

In some embodiments, $X_{16}$ is K and $X_{19}$ is V. In some embodiments, $X_{16}$ is K and $X_{19}$ is A. In some embodiments, $X_{16}$ is K and $X_{20}$ is R. In some embodiments, $X_{16}$ is K and $X_{20}$ is K. In some embodiments, $X_{16}$ is K and $X_{21}$ is K. In some embodiments, $X_{16}$ is K and $X_{21}$ is Q. In some embodiments, $X_{16}$ is K and $X_{24}$ is S. In some embodiments, $X_{16}$ is K and $X_{24}$ is E.

In some embodiments, $X_{19}$ is V and $X_{20}$ is R. In some embodiments, $X_{19}$ is V and $X_{20}$ is K. In some embodiments, $X_{19}$ is V and $X_{21}$ is K. In some embodiments, $X_{19}$ is V and $X_{21}$ is Q. In some embodiments, $X_{19}$ is V and $X_{24}$ is S. In some embodiments, $X_{19}$ is V and $X_{24}$ is E.

In some embodiments, $X_{19}$ is A and $X_{20}$ is R. In some embodiments, $X_{19}$ is A and $X_{20}$ is K. In some embodiments, $X_{19}$ is A and $X_{21}$ is K. In some embodiments, $X_{19}$ is A and $X_{21}$ is Q. In some embodiments, $X_{19}$ is A and $X_{24}$ is S. In some embodiments, $X_{19}$ is A and $X_{24}$ is E.

In some embodiments, $X_{20}$ is R and $X_{21}$ is K. In some embodiments, $X_{20}$ is R and $X_{21}$ is Q. In some embodiments, $X_{20}$ is R and $X_{24}$ is S. In some embodiments, $X_{20}$ is R and $X_{24}$ is E.

In some embodiments, $X_{20}$ is K and $X_{21}$ is K. In some embodiments, $X_{20}$ is K and $X_{21}$ is Q. In some embodiments, $X_{20}$ is K and $X_{24}$ is S. In some embodiments, $X_{20}$ is K and $X_{24}$ is E.

In some embodiments, $X_{21}$ is K and $X_{24}$ is S. In some embodiments, $X_{21}$ is K and $X_{24}$ is E. In some embodiments, $X_{21}$ is Q and $X_{24}$ is S. In some embodiments, $X_{21}$ is Q and $X_{24}$ is E.

In some embodiments, certain amino acids represented by the consensus sequence of SEQ ID NO: 210 include the following:

In some embodiments, $X_2$ is Aib, $X_{10}$ is V, and $X_{14}$ is Y. In some embodiments, $X_2$ is Aib, $X_{10}$ is V, and $X_{16}$ is K. In some embodiments, $X_2$ is Aib, $X_{10}$ is V, and $X_{19}$ is V. In some embodiments, $X_2$ is Aib, $X_{10}$ is V, and $X_{19}$ is A. In some embodiments, $X_2$ is Aib, $X_{10}$ is V, and $X_{20}$ is R. In some embodiments, $X_2$ is Aib, $X_{10}$ is V, and $X_{20}$ is K. In some embodiments, $X_2$ is Aib, $X_{10}$ is V, and $X_{21}$ is K. In some embodiments, $X_2$ is Aib, $X_{10}$ is V, and $X_{21}$ is Q. In some embodiments, $X_2$ is Aib, $X_{10}$ is V, and $X_{24}$ is S. In some embodiments, $X_2$ is Aib, $X_{10}$ is V, and $X_{24}$ is E.

In some embodiments, $X_2$ is Aib, $X_{14}$ is Y, and $X_{16}$ is K. In some embodiments, $X_2$ is Aib, $X_{14}$ is Y, and $X_{19}$ is V. In some embodiments, $X_2$ is Aib, $X_{14}$ is Y, and $X_{19}$ is A. In some embodiments, $X_2$ is Aib, $X_{14}$ is Y, and $X_{20}$ is R. In some embodiments, $X_2$ is Aib, $X_{14}$ is Y, and $X_{20}$ is K. In some embodiments, $X_2$ is Aib, $X_{14}$ is Y, and $X_{21}$ is K. In some embodiments, $X_2$ is Aib, $X_{14}$ is Y, and $X_{21}$ is Q. In some embodiments, $X_2$ is Aib, $X_{14}$ is Y, and $X_{24}$ is S. In some embodiments, $X_2$ is Aib, $X_{14}$ is Y, and $X_{24}$ is E.

In some embodiments, $X_{10}$ is V, $X_{14}$ is Y, and $X_{16}$ is K. In some embodiments, $X_{10}$ is V, $X_{14}$ is Y, and $X_{19}$ is V. In some embodiments, $X_{10}$ is V, $X_{14}$ is Y, and $X_{19}$ is A. In some embodiments, $X_{10}$ is V, $X_{14}$ is Y, and $X_{20}$ is R. In some embodiments, $X_{10}$ is V, $X_{14}$ is Y, and $X_{20}$ is K. In some embodiments, $X_{10}$ is V, $X_{14}$ is Y, and $X_{21}$ is K. In some embodiments, $X_{10}$ is V, $X_{14}$ is Y, and $X_{21}$ is Q. In some embodiments, $X_{10}$ is V, $X_{14}$ is Y, and $X_{24}$ is S. In some embodiments, $X_{10}$ is V, $X_{14}$ is Y, and $X_{24}$ is E.

In some embodiments, $X_{14}$ is Y, $X_{16}$ is K, and $X_{19}$ is V. In some embodiments, $X_{14}$ is Y, $X_{16}$ is K, and $X_{19}$ is A. In some embodiments, $X_{14}$ is Y, $X_{16}$ is K, and $X_{20}$ is R. In some embodiments, $X_{14}$ is Y, $X_{16}$ is K, and $X_{20}$ is K. In some embodiments, $X_{14}$ is Y, $X_{16}$ is K, and $X_{21}$ is K. In some embodiments, $X_{14}$ is Y, $X_{16}$ is K, and $X_{21}$ is Q. In some embodiments, $X_{14}$ is Y, $X_{16}$ is K, and $X_{24}$ is S. In some embodiments, $X_{14}$ is Y, $X_{16}$ is K, and $X_{24}$ is E.

In some embodiments, $X_{14}$ is Y, $X_{19}$ is V, and $X_{21}$ is K. In some embodiments, $X_{14}$ is Y, $X_{19}$ is A, and $X_{21}$ is K. In some embodiments, $X_{14}$ is Y, $X_{20}$ is R, and $X_{21}$ is K. In some embodiments, $X_{14}$ is Y, $X_{20}$ is K, and $X_{21}$ is K. In some embodiments, $X_{14}$ is Y, $X_{21}$ is K, and $X_{24}$ is S. In some embodiments, $X_{14}$ is Y, $X_{21}$ is K, and $X_{24}$ is E.

In some embodiments, $X_{16}$ is K, $X_{19}$ is A, and $X_{20}$ is R. In some embodiments, $X_{16}$ is K, $X_{19}$ is A, and $X_{20}$ is K. In some embodiments, $X_{16}$ is K, $X_{19}$ is A, and $X_{21}$ is K. In some embodiments, $X_{16}$ is K, $X_{19}$ is A, and $X_{21}$ is Q. In some embodiments, $X_{16}$ is K, $X_{19}$ is A, and $X_{24}$ is S. In some embodiments, $X_{16}$ is K, $X_{19}$ is A, and $X_{24}$ is E.

In some embodiments, $X_{19}$ is V, $X_{20}$ is R, and $X_{21}$ is K. In some embodiments, $X_{19}$ is V, $X_{20}$ is R, and $X_{21}$ is Q. In some embodiments, $X_{19}$ is V, $X_{20}$ is R, and $X_{24}$ is S. In some embodiments, $X_{19}$ is V, $X_{20}$ is R, and $X_{24}$ is E.

In some embodiments, $X_{19}$ is A, $X_{20}$ is R, and $X_{21}$ is K. In some embodiments, $X_{19}$ is A, $X_{20}$ is R, and $X_{21}$ is Q. In some embodiments, $X_{19}$ is A, $X_{20}$ is R, and $X_{24}$ is S. In some embodiments, $X_{19}$ is A, $X_{20}$ is R, and $X_{24}$ is E.

In some embodiments, $X_{20}$ is R, $X_{21}$ is K, and $X_{24}$ is S. In some embodiments, $X_{20}$ is R, $X_{21}$ is K, and $X_{24}$ is E.

In some embodiments, $X_{20}$ is K, $X_{21}$ is K, and $X_{24}$ is S. In some embodiments, $X_{20}$ is K, $X_{21}$ is K, and $X_{24}$ is E.

In certain embodiments, the present invention provides an isolated polypeptide, comprising the amino acid sequence of SEQ ID NO: 200: $HX_2X_3GTX_6X_7X_8X_9X_{10}SX_{12}X_{13}X_{14}EX_{16}X_{17}X_{18}X_{19}X_{20}X_{21}FIX_{24}WL$ $KX_{28}GGPX_{32}SGAPPPS-(OH/NH_2)$ (SEQ ID NO: 200) or a pharmaceutically acceptable salt thereof, wherein:

$X_2$ is A, 2-aminoisobutyric acid (Aib), or G;
$X_3$ is E or N-methyl Glu;
$X_6$ is F or Y;
$X_7$ is S or T;
$X_8$ is diaminopimelic acid (Dap), E, K, N, N-methyl Ser, Q, S, s, or Y;
$X_9$ is D or E;
$X_{10}$ is I, L, N-methyl Leu, or V;
$X_{12}$ is E, K, Q, or S;
$X_{13}$ is Aib, E, K, Q, S, W, or Y;
$X_{14}$ is E, R, I, K, L, M, Q, or Y;
$X_{16}$ is 2,4-diaminobutanoic acid (Dab), Dap, E, K, k, or ornithine (Orn);
$X_{17}$ is E, K, or Q;
$X_{18}$ is A, K, S, or Y;
$X_{19}$ is A, K, or V;
$X_{20}$ is E, K, or R;
$X_{21}$ is Aib, E, H, K, L, Q, or Y;
$X_{24}$ is A, Aib, E, K, Q, S, or Y;
$X_{28}$ is D, E, K, N, Q, S, or Y; and
$X_{32}$ is Dap, H, K, R, or S;
wherein when $X_{16}$ is Dab, Dap, K, k, or Orn, it is covalently bound to a lipophilic substituent, optionally via a spacer;
wherein when $X_{16}$ is E, at least one of $X_{14}$, $X_{17}$, $X_{18}$, $X_{19}$, $X_{20}$, or $X_{21}$ is selected to be lysine wherein the lysine residue is covalently bound to a lipophilic substituent, optionally via a spacer; and wherein the isolated polypeptide optionally further comprises two amino acid residues having side chains that are covalently joined to form a bridging moiety.

In one embodiment, the isolated polypeptide is not an analogue of exenatide, HGEGTFTSDLSKQMEEEAVRLFIEWLKNGGPSSGAPPPS-NH$_2$ (SEQ ID NO: 300), having K$_{12}$ or K$_{27}$ covalently bound to a lipophilic substituent, optionally via a spacer.

In some embodiments, $X_2$ is Aib.

In some embodiments, if $X_{24}$ is S, then $X_{10}$ is V.

In some embodiments, $X_{14}$ is Y.

In some embodiments, $X_{14}$ is M, and $X_{16}$ is K covalently bound to a lipophilic substituent, optionally via a spacer.

In some embodiments, $X_{16}$ is K covalently bound to a lipophilic substituent, optionally via a spacer.

In some embodiments, if $X_{16}$ is E, then $X_{21}$ is K or E. In some embodiments, if $X_{16}$ is E, then $X_{21}$ is K. In some embodiments, if $X_{16}$ is E, then $X_{21}$ is E.

In some embodiments, the peptide further comprises a lactam bridge formed via an amide bond between the side chains of a lysine and a glutamic acid at positions $X_{20}$ and $X_{24}$, respectively.

In some embodiments, $X_2$ is A. In some embodiments, $X_2$ is Aib. In some embodiments, $X_2$ is G.

In some embodiments, $X_3$ is E. In some embodiments, $X_3$ is N-methyl Glu.

In some embodiments, $X_6$ is F. In some embodiments, $X_6$ is Y.

In some embodiments, $X_7$ is S. In some embodiments, $X_7$ is T.

In some embodiments, $X_8$ is Dap. In some embodiments, $X_8$ is E. In some embodiments, $X_8$ is K. In some embodiments, $X_8$ is N. In some embodiments, $X_8$ is N-methyl Ser. In some embodiments, $X_8$ is Q. In some embodiments, $X_8$ is S. In some embodiments, $X_8$ is s. In some embodiments, $X_8$ is Y.

In some embodiments, $X_9$ is D. In some embodiments, $X_9$ is E.

In some embodiments, $X_{10}$ is I. In some embodiments, $X_{10}$ is L. In some embodiments, $X_{10}$ is N-methyl Leu. In some embodiments, $X_{10}$ is V.

In some embodiments, $X_{12}$ is E. In some embodiments, $X_{12}$ is K. In some embodiments, $X_{12}$ is Q. In some embodiments, $X_{12}$ is S.

In some embodiments, $X_{13}$ is Aib. In some embodiments, $X_{13}$ is E. In some embodiments, $X_{13}$ is K. In some embodiments, $X_{13}$ is Q. In some embodiments, $X_{13}$ is S. In some embodiments, $X_{13}$ is W. In some embodiments, $X_{13}$ is Y.

In some embodiments, $X_{14}$ is E. In some embodiments, $X_{14}$ is R. In some embodiments, $X_{14}$ is I. In some embodiments, $X_{14}$ is K. In some embodiments, $X_{14}$ is L. In some embodiments, $X_{14}$ is M. In some embodiments, $X_{14}$ is Q. In some embodiments, $X_{14}$ is Y.

In some embodiments, $X_{17}$ is E. In some embodiments, $X_{17}$ is K. In some embodiments, $X_{17}$ is Q.

In some embodiments, $X_{18}$ is A. In some embodiments, $X_{18}$ is K. In some embodiments, $X_{18}$ is S. In some embodiments, $X_{18}$ is Y.

In some embodiments, $X_{19}$ is A. In some embodiments, $X_{19}$ is K. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is Aib. In some embodiments, $X_{21}$ is E. In some embodiments, $X_{21}$ is H. In some embodiments, $X_{21}$ is K. In some embodiments, $X_{21}$ is L. In some embodiments, $X_{21}$ is Q. In some embodiments, $X_{21}$ is Y.

In some embodiments, $X_{24}$ is A. In some embodiments, $X_{24}$ is Aib. In some embodiments, $X_{24}$ is E. In some embodiments, $X_{24}$ is K. In some embodiments, $X_{24}$ is Q. In some embodiments, $X_{24}$ is S. In some embodiments, $X_{24}$ is Y.

In some embodiments, $X_{28}$ is D. In some embodiments, $X_{28}$ is E. In some embodiments, $X_{28}$ is K. In some embodiments, $X_{28}$ is N. In some embodiments, $X_{28}$ is Q. In some embodiments, $X_{28}$ is S. In some embodiments, $X_{28}$ is Y.

In some embodiments, $X_{32}$ is Dap. In some embodiments, $X_{32}$ is H. In some embodiments, $X_{32}$ is K. In some embodiments, $X_{32}$ is R. In some embodiments, $X_{32}$ is S.

In some embodiments, carboxy terminal amino acid, i.e. Sc, is —$S_{39}$—(NH$_2$). In some embodiments, carboxy terminal amino acid $S_{39}$ is —$S_{39}$—(OH).

In some embodiments, $X_{16}$ is Dab, Dap, K, or Orn covalently bound to a lipophilic substituent, optionally via a spacer. In some embodiments, $X_{16}$ is Dab, covalently bound to a lipophilic substituent, optionally via a spacer. In some embodiments, $X_{16}$ is Dap, covalently bound to a lipophilic substituent, optionally via a spacer. In some embodiments, $X_{16}$ is K, covalently bound to a lipophilic substituent, optionally via a spacer. In some embodiments, $X_{16}$ is k, covalently bound to a lipophilic substituent, optionally via a spacer. In some embodiments, $X_{16}$ is Orn, covalently bound to a lipophilic substituent, optionally via a spacer.

In some embodiments, $X_{16}$ is E, and at least one of $X_{14}$, $X_{17}$, $X_{18}$, $X_{19}$, $X_{20}$, or $X_{21}$ is selected to be lysine wherein the lysine residue is covalently bound to a lipophilic substituent, optionally via a spacer. In some embodiments, $X_{16}$ is E, and $X_{14}$ is lysine wherein the lysine residue is covalently bound to a lipophilic substituent, optionally via a spacer. In some embodiments, $X_{16}$ is E, and $X_{17}$ is lysine wherein the lysine residue is covalently bound to a lipophilic substituent, optionally via a spacer. In some embodiments, $X_{16}$ is E, and $X_{18}$ is lysine wherein the lysine residue is covalently bound to a lipophilic substituent, optionally via a spacer. In some embodiments, $X_{16}$ is E, and $X_{19}$ is lysine wherein the lysine residue is covalently bound to a lipophilic substituent, optionally via a spacer. In some embodiments, $X_{16}$ is E, and $X_{20}$ is lysine wherein the lysine residue is covalently bound to a lipophilic substituent, optionally via a spacer. In some embodiments, $X_{16}$ is E, and $X_{21}$ is lysine wherein the lysine residue is covalently bound to a lipophilic substituent, optionally via a spacer.

In some embodiments, the isolated polypeptide further comprises two amino acid residues having side chains that are covalently joined to form a bridging moiety. In some embodiments, the isolated polypeptide optionally further comprises two amino acid residues, wherein one is lysine (K) and the other is glutamic acid (E), and wherein the amino-containing sidechain of lysine and the carboxy-containing sidechain of glutamic acid are covalently joined, with loss of water, to form a lactam bridging moiety. In some embodiments, the lactam bridging moiety is formed via covalent bonds between side chains of a lysine (K) and a glutamic acid (E) residues at positions $X_{17}$ and $X_{21}$, respectively; at positions $X_{21}$ and $X_{17}$, respectively; at positions $X_{21}$ and $X_{28}$, respectively; at positions $X_{28}$ and $X_{21}$, respectively; at positions $X_{20}$ and $X_{24}$, respectively; at positions $X_{24}$ and $X_{20}$, respectively; or at positions $X_{12}$ and $X_{16}$, respectively. In some embodiments, the lactam bridging moiety is formed between side chains of a lysine (K) and a glutamic acid (E) residues at positions $X_{17}$ and $X_{21}$, respectively. In some embodiments, the lactam bridging moiety is formed between side chains of a lysine (K) and a glutamic acid (E) residues at positions $X_{21}$ and $X_{17}$, respectively. In some embodiments, the lactam bridging moiety is formed between side chains of a lysine (K) and a glutamic acid (E) residues at positions $X_{21}$ and $X_{28}$, respectively. In some embodiments, the lactam bridging moiety is formed between side chains of a lysine (K) and a glutamic acid (E) residues at positions $X_{28}$ and $X_{21}$, respectively. In some embodiments, the lactam bridging moiety is formed between side chains of a lysine (K) and a glutamic acid (E) residues at positions $X_{20}$ and $X_{24}$, respectively. In some embodiments, the lactam bridging moiety is formed between side chains of a lysine (K) and a glutamic acid (E) residues at positions $X_{24}$ and $X_{20}$, respectively. In some embodiments, the lactam bridging moiety is formed covalent bonds between side chains of a lysine (K) and a glutamic acid (E) residues at positions $X_{12}$ and $X_{16}$, respectively.

In some embodiments, when K is selected at position $X_8$, $X_{12}$, $X_{13}$, $X_{14}$, $X_{17}$, $X_{18}$, $X_{19}$, $X_{20}$, $X_{21}$, $X_{24}$, $X_{28}$, or $X_{32}$, it represents lysine optionally covalently bound to a lipophilic substituent, optionally via a spacer.

In some embodiments, when K is selected at position $X_{14}$, $X_{17}$, $X_{18}$, $X_{19}$, $X_{20}$, or $X_{21}$, it represents lysine optionally covalently bound to a lipophilic substituent, optionally via a spacer.

In some embodiments, only the residue at $X_{16}$ may be covalently bound to a lipophilic substituent, optionally via a spacer.

In certain embodiments, the present invention provides an isolated polypeptide, comprising the amino acid sequence of SEQ ID NO: 201 or a pharmaceutically acceptable salt thereof, wherein:
H$X_2X_3$GT$X_6X_7X_8X_9X_{10}$S $X_{12}X_{13}$YE$X_{16}X_{17}X_{18}X_{19}X_{20}X_{21}$FI$X_{24}$WLK$X_{28}$G GP$X_{32}$SGAPPPS-(OH/NH$_2$) (SEQ ID NO: 201) or a pharmaceutically acceptable salt thereof, wherein:
  $X_2$ is A, 2-aminoisobutyric acid (Aib), or G;
  $X_3$ is E or N-methyl Glu;
  $X_6$ is F or Y;
  $X_7$ is S or T;
  $X_8$ is diaminopimelic acid (Dap), E, K, N, N-methyl Ser, Q, S, s, or Y;
  $X_9$ is D or E;
  $X_{10}$ is I, L, N-methyl Leu, or V;
  $X_{12}$ is E, K, Q, or S;
  $X_{13}$ is Aib, E, K, Q, S, W, or Y;
  $X_{16}$ is K covalently bound to a lipophilic substituent, optionally via a spacer;
  $X_{17}$ is E, K, or Q;
  $X_{18}$ is A, K, S, or Y;
  $X_{19}$ is A, K, or V;
  $X_{20}$ is E, K, or R;
  $X_{21}$ is Aib, E, H, K, L, Q, or Y;
  $X_{24}$ is A, Aib, E, K, Q, S, or Y;
  $X_{28}$ is D, E, K, N, Q, S, or Y; and
  $X_{32}$ is Dap, H, K, R, or S;
  wherein the peptide optionally further comprises a lactam bridge formed via an amide bond between the side chains of a lysine and a glutamic acid at positions $X_{17}$ and $X_{21}$, respectively; at positions $X_{21}$ and $X_{17}$, respectively; at positions $X_{21}$ and $X_{28}$, respectively; at positions $X_{28}$ and $X_{21}$, respectively; at positions $X_{20}$ and $X_{24}$, respectively; or at positions $X_{24}$ and $X_{20}$, respectively.

In embodiments, $X_2$ is Aib.
In some embodiments, if $X_{24}$ is S, then $X_{10}$ is V.

In some embodiments, the peptide further comprises a lactam bridge formed via an amide bond between the side chains of a lysine and a glutamic acid at positions $X_{20}$ and $X_{24}$, respectively.

In some embodiments, $X_2$ is A. In some embodiments, $X_2$ is Aib. In some embodiments, $X_2$ is G.

In some embodiments, $X_3$ is E. In some embodiments, $X_3$ is N-methyl Glu.

In some embodiments, $X_6$ is F. In some embodiments, $X_6$ is Y.

In some embodiments, $X_7$ is S. In some embodiments, $X_7$ is T.

In some embodiments, $X_8$ is Dap. In some embodiments, $X_8$ is E. In some embodiments, $X_8$ is K. In some embodiments, $X_8$ is N. In some embodiments, $X_8$ is N-methyl Ser. In some embodiments, $X_8$ is Q. In some embodiments, $X_8$ is S. In some embodiments, $X_8$ is s. In some embodiments, $X_8$ is Y.

In some embodiments, $X_9$ is D. In some embodiments, $X_9$ is E.

In some embodiments, $X_{10}$ is I. In some embodiments, $X_{10}$ is L. In some embodiments, $X_{10}$ is N-methyl Leu. In some embodiments, $X_{10}$ is V.

In some embodiments, $X_{12}$ is E. In some embodiments, $X_{12}$ is K. In some embodiments, $X_{12}$ is Q. In some embodiments, $X_{12}$ is S.

In some embodiments, $X_{13}$ is Aib. In some embodiments, $X_{13}$ is E. In some embodiments, $X_{13}$ is K. In some embodiments, $X_{13}$ is Q. In some embodiments, $X_{13}$ is S. In some embodiments, $X_{13}$ is W. In some embodiments, $X_{13}$ is Y.

In some embodiments, $X_{17}$ is E. In some embodiments, $X_{17}$ is K. In some embodiments, $X_{17}$ is Q.

In some embodiments, $X_{18}$ is A. In some embodiments, $X_{18}$ is K. In some embodiments, $X_{18}$ is S. In some embodiments, $X_{18}$ is Y.

In some embodiments, $X_{19}$ is A. In some embodiments, $X_{19}$ is K. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is Aib. In some embodiments, $X_{21}$ is E. In some embodiments, $X_{21}$ is H. In some embodiments, $X_{21}$ is K. In some embodiments, $X_{21}$ is L. In some embodiments, $X_{21}$ is Q. In some embodiments, $X_{21}$ is Y.

In some embodiments, $X_{24}$ is A. In some embodiments, $X_{24}$ is Aib. In some embodiments, $X_{24}$ is E. In some embodiments, $X_{24}$ is K. In some embodiments, $X_{24}$ is Q. In some embodiments, $X_{24}$ is S. In some embodiments, $X_{24}$ is Y.

In some embodiments, $X_{28}$ is D. In some embodiments, $X_{28}$ is E. In some embodiments, $X_{28}$ is K. In some embodiments, $X_{28}$ is N. In some embodiments, $X_{28}$ is Q. In some embodiments, $X_{28}$ is S. In some embodiments, $X_{28}$ is Y.

In some embodiments, $X_{32}$ is Dap. In some embodiments, $X_{32}$ is H. In some embodiments, $X_{32}$ is K. In some embodiments, $X_{32}$ is R. In some embodiments, $X_{32}$ is S.

In some embodiments, carboxy terminal amino acid, i.e. $S_{39}$, is —$S_{39}$—(NH$_2$). In some embodiments, carboxy terminal amino acid $S_{39}$ is —$S_{39}$—(OH).

In some embodiments, the isolated peptide further comprises a lactam bridge formed via an amide bond between the side chains of a lysine and a glutamic acid at positions $X_{17}$ and $X_{21}$, respectively. In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{21}$ and $X_{28}$, respectively. In some embodiments, the isolated peptide further comprises a lactam bridge formed via an amide bond between the side chains of a lysine and a glutamic acid at positions $X_{28}$ and $X_{21}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively.

In some embodiments, when K is selected at position $X_8$, $X_{12}$, $X_{13}$, $X_{17}$, $X_{18}$, $X_{19}$, $X_{20}$, $X_{21}$, $X_{24}$, $X_{28}$, or $X_{32}$, it represents lysine optionally covalently bound to a lipophilic substituent, optionally via a spacer.

In some embodiments, when K is selected at position $X_{17}$, $X_{18}$, $X_{19}$, $X_{20}$, or $X_{21}$, it represents lysine optionally covalently bound to a lipophilic substituent, optionally via a spacer.

In some embodiments, only the residue at $X_{16}$ is covalently bound to a lipophilic substituent, optionally via a spacer.

In some embodiments, certain amino acids represented by the consensus sequence of SEQ ID NO: 200 or SEQ ID NO: 201 include the following:

In some embodiments, $X_2$ is Aib and $X_{10}$ is V. In some embodiments, $X_2$ is Aib and $X_{14}$ is Y. In some embodiments, $X_2$ is Aib and $X_{16}$ is K covalently bound to a lipophilic substituent, optionally via a spacer. In some embodiments, $X_2$ is Aib and $X_{19}$ is V. In some embodiments, $X_2$ is Aib and $X_{19}$ is A. In some embodiments, $X_2$ is Aib and $X_{20}$ is R. In some embodiments, $X_2$ is Aib and $X_{20}$ is K. In some embodiments, $X_2$ is Aib and $X_{21}$ is K. In some embodiments, $X_2$ is Aib and $X_{21}$ is Q. In some embodiments, $X_2$ is Aib and $X_{24}$ is S. In some embodiments, $X_2$ is Aib and $X_{24}$ is E.

In some embodiments, $X_{10}$ is V and $X_{14}$ is Y. In some embodiments, $X_{10}$ is V and $X_{16}$ is K covalently bound to a lipophilic substituent, optionally via a spacer. In some embodiments, $X_{10}$ is V and $X_{19}$ is V. In some embodiments, $X_{10}$ is V and $X_{19}$ is A. In some embodiments, $X_{10}$ is V and $X_{20}$ is R. In some embodiments, $X_{10}$ is V and $X_{20}$ is K. In some embodiments, $X_{10}$ is V and $X_{21}$ is K. In some embodiments, $X_{10}$ is V and $X_{21}$ is Q. In some embodiments, $X_{10}$ is V and $X_{24}$ is S. In some embodiments, $X_{10}$ is V and $X_{24}$ is E.

In some embodiments, $X_{14}$ is Y and $X_{16}$ is K covalently bound to a lipophilic substituent, optionally via a spacer. In some embodiments, $X_{14}$ is Y and $X_{19}$ is V. In some embodiments, $X_{14}$ is Y and $X_{19}$ is A. In some embodiments, $X_{14}$ is Y and $X_{20}$ is R. In some embodiments, $X_{14}$ is Y and $X_{20}$ is K. In some embodiments, $X_{14}$ is Y and $X_{21}$ is K. In some embodiments, $X_{14}$ is Y and $X_{21}$ is Q. In some embodiments, $X_{14}$ is Y and $X_{24}$ is S. In some embodiments, $X_{14}$ is Y and $X_{24}$ is E.

In some embodiments, $X_{16}$ is K covalently bound to a lipophilic substituent, optionally via a spacer, and $X_{19}$ is V. In some embodiments, $X_{16}$ is K covalently bound to a lipophilic substituent, optionally via a spacer, and $X_{19}$ is A. In some embodiments, $X_{16}$ is K covalently bound to a lipophilic substituent, optionally via a spacer, and $X_{20}$ is R. In some embodiments, $X_{16}$ is K covalently bound to a lipophilic substituent, optionally via a spacer, and $X_{20}$ is K. In some embodiments, $X_{16}$ is K covalently bound to a lipophilic substituent, optionally via a spacer, and $X_{21}$ is K. In some embodiments, $X_{16}$ is K covalently bound to a lipophilic substituent, optionally via a spacer, and $X_{21}$ is Q. In some embodiments, $X_{16}$ is K covalently bound to a lipophilic substituent, optionally via a spacer, and $X_{24}$ is S. In some embodiments, $X_{16}$ is K covalently bound to a lipophilic substituent, optionally via a spacer, and $X_{24}$ is E.

In some embodiments, $X_{19}$ is V and $X_{20}$ is R. In some embodiments, $X_{19}$ is V and $X_{20}$ is K. In some embodiments, $X_{19}$ is V and $X_{21}$ is K. In some embodiments, $X_{19}$ is V and $X_{21}$ is Q. In some embodiments, $X_{19}$ is V and $X_{24}$ is S. In some embodiments, $X_{19}$ is V and $X_{24}$ is E.

In some embodiments, $X_{19}$ is A and $X_{20}$ is R. In some embodiments, $X_{19}$ is A and $X_{20}$ is K. In some embodiments, $X_{19}$ is A and $X_{21}$ is K. In some embodiments, $X_{19}$ is A and $X_{21}$ is Q. In some embodiments, $X_{19}$ is A and $X_{24}$ is S. In some embodiments, $X_{19}$ is A and $X_{24}$ is E.

In some embodiments, $X_{20}$ is R and $X_{21}$ is K. In some embodiments, $X_{20}$ is R and $X_{21}$ is Q. In some embodiments, $X_{20}$ is R and $X_{24}$ is S. In some embodiments, $X_{20}$ is R and $X_{24}$ is E.

In some embodiments, $X_{20}$ is K and $X_{21}$ is K. In some embodiments, $X_{20}$ is K and $X_{21}$ is Q. In some embodiments, $X_{20}$ is K and $X_{24}$ is S. In some embodiments, $X_{20}$ is K and $X_{24}$ is E. In some embodiments, $X_{20}$ is K, $X_{24}$ is E, and the peptide comprises a lactam bridge formed via an amide bond between the side chains of $X_{20}$ and $X_{24}$.

In some embodiments, $X_{21}$ is K and $X_{24}$ is S. In some embodiments, $X_{21}$ is K and $X_{24}$ is E.

In some embodiments, $X_{21}$ is Q and $X_{24}$ is S. In some embodiments, $X_{21}$ is Q and $X_{24}$ is E.

In some embodiments, certain amino acids represented by the consensus sequence of SEQ ID NO: 200 or SEQ ID NO: 201 include the following:

In some embodiments, $X_2$ is Aib, $X_{10}$ is V, and $X_{14}$ is Y. In some embodiments, $X_2$ is Aib, $X_{10}$ is V, and $X_{16}$ is K covalently bound to a lipophilic substituent, optionally via a spacer. In some embodiments, $X_2$ is Aib, $X_{10}$ is V, and $X_{19}$ is V. In some embodiments, $X_2$ is Aib, $X_{10}$ is V, and $X_{19}$ is A. In some embodiments, $X_2$ is Aib, $X_{10}$ is V, and $X_{20}$ is R. In some embodiments, $X_2$ is Aib, $X_{10}$ is V, and $X_{20}$ is K. In some embodiments, $X_2$ is Aib, $X_{10}$ is V, and $X_{21}$ is K. In some embodiments, $X_2$ is Aib, $X_{10}$ is V, and $X_{21}$ is Q. In some embodiments, $X_2$ is Aib, $X_{10}$ is V, and $X_{24}$ is S. In some embodiments, $X_2$ is Aib, $X_{10}$ is V, and $X_{24}$ is E.

In some embodiments, $X_2$ is Aib, $X_{14}$ is Y, and $X_{16}$ is K covalently bound to a lipophilic substituent, optionally via a spacer. In some embodiments, $X_2$ is Aib, $X_{14}$ is Y, and $X_{19}$ is V. In some embodiments, $X_2$ is Aib, $X_{14}$ is Y, and $X_{19}$ is A. In some embodiments, $X_2$ is Aib, $X_{14}$ is Y, and $X_{20}$ is R. In some embodiments, $X_2$ is Aib, $X_{14}$ is Y, and $X_{20}$ is K. In some embodiments, $X_2$ is Aib, $X_{14}$ is Y, and $X_{21}$ is K. In some embodiments, $X_2$ is Aib, $X_{14}$ is Y, and $X_{21}$ is Q. In some embodiments, $X_2$ is Aib, $X_{14}$ is Y, and $X_{24}$ is S. In some embodiments, $X_2$ is Aib, $X_{14}$ is Y, and $X_{24}$ is E.

In some embodiments, $X_{10}$ is V, $X_{14}$ is Y, and $X_{16}$ is K covalently bound to a lipophilic substituent, optionally via a spacer. In some embodiments, $X_{10}$ is V, $X_{14}$ is Y, and $X_{19}$ is V. In some embodiments, $X_{10}$ is V, $X_{14}$ is Y, and $X_{19}$ is A. In some embodiments, $X_{10}$ is V, $X_{14}$ is Y, and $X_{20}$ is R. In some embodiments, $X_{10}$ is V, $X_{14}$ is Y, and $X_{20}$ is K. In some embodiments, $X_{10}$ is V, $X_{14}$ is Y, and $X_{21}$ is K. In some embodiments, $X_{10}$ is V, $X_{14}$ is Y, and $X_{21}$ is Q. In some embodiments, $X_{10}$ is V, $X_{14}$ is Y, and $X_{24}$ is S. In some embodiments, $X_{10}$ is V, $X_{14}$ is Y, and $X_{24}$ is E.

In some embodiments, $X_{14}$ is Y; $X_{16}$ is K covalently bound to a lipophilic substituent, optionally via a spacer; and $X_{19}$ is V. In some embodiments, $X_{14}$ is Y; $X_{16}$ is K covalently bound to a lipophilic substituent, optionally via a spacer; and $X_{19}$ is A. In some embodiments, $X_{14}$ is Y; $X_{16}$ is K covalently bound to a lipophilic substituent, optionally via a spacer; and $X_{20}$ is R. In some embodiments, $X_{14}$ is Y; $X_{16}$ is K covalently bound to a lipophilic substituent, optionally via a spacer; and $X_{20}$ is K. In some embodiments, $X_{14}$ is Y; $X_{16}$ is K covalently bound to a lipophilic substituent, optionally via a spacer; and $X_{21}$ is K. In some embodiments, $X_{14}$ is Y; $X_{16}$ is K covalently bound to a lipophilic substituent, optionally via a spacer; and $X_{21}$ is Q. In some embodiments, $X_{14}$ is Y; $X_{16}$ is K covalently bound to a lipophilic substituent, optionally via a spacer; and $X_{24}$ is S. In some embodiments, $X_{14}$ is Y; $X_{16}$ is K covalently bound to a lipophilic substituent, optionally via a spacer; and $X_{24}$ is E.

In some embodiments, $X_{14}$ is Y, $X_{19}$ is V, and $X_{21}$ is K. In some embodiments, $X_{14}$ is Y, $X_{19}$ is A, and $X_{21}$ is K. In some embodiments, $X_{14}$ is Y, $X_{20}$ is R, and $X_{21}$ is K. In some embodiments, $X_{14}$ is Y, $X_{20}$ is K, and $X_{21}$ is K. In some embodiments, $X_{14}$ is Y, $X_{21}$ is K, and $X_{24}$ is S. In some embodiments, $X_{14}$ is Y, $X_{21}$ is K, and $X_{24}$ is E.

In some embodiments, $X_{16}$ is K covalently bound to a lipophilic substituent, optionally via a spacer; $X_{19}$ is A; and $X_{20}$ is R. In some embodiments, $X_{16}$ is K covalently bound to a lipophilic substituent, optionally via a spacer; $X_{19}$ is A; and $X_{20}$ is K. In some embodiments, $X_{16}$ is K covalently bound to a lipophilic substituent, optionally via a spacer; $X_{19}$ is A; and $X_{21}$ is K. In some embodiments, $X_{16}$ is K covalently bound to a lipophilic substituent, optionally via a spacer; $X_{19}$ is A; and $X_{21}$ is Q. In some embodiments, $X_{16}$ is K covalently bound to a lipophilic substituent, optionally via a spacer; $X_{19}$ is A; and $X_{24}$ is S. In some embodiments, $X_{16}$ is K covalently bound to a lipophilic substituent, optionally via a spacer; $X_{19}$ is A; and $X_{24}$ is E.

In some embodiments, $X_{19}$ is V, $X_{20}$ is R, and $X_{21}$ is K. In some embodiments, $X_{19}$ is V, $X_{20}$ is R, and $X_{21}$ is Q. In some embodiments, $X_{19}$ is V, $X_{20}$ is R, and $X_{24}$ is S. In some embodiments, $X_{19}$ is V, $X_{20}$ is R, and $X_{24}$ is E.

In some embodiments, $X_{19}$ is A, $X_{20}$ is R, and $X_{21}$ is K. In some embodiments, $X_{19}$ is A, $X_{20}$ is R, and $X_{21}$ is Q. In some embodiments, $X_{19}$ is A, $X_{20}$ is R, and $X_{24}$ is S. In some embodiments, $X_{19}$ is A, $X_{20}$ is R, and $X_{24}$ is E.

In some embodiments, $X_{20}$ is R, $X_{21}$ is K, and $X_{24}$ is S. In some embodiments, $X_{20}$ is R, $X_{21}$ is K, and $X_{24}$ is E. In some embodiments, $X_{20}$ is K, $X_{21}$ is K, and $X_{24}$ is S. In some embodiments, $X_{20}$ is K, $X_{21}$ is K, and $X_{24}$ is E. In some embodiments, $X_{20}$ is K, $X_{21}$ is K, $X_{24}$ is E, and the peptide comprises a lactam bridge formed via an amide bond between the side chains of $X_{20}$ and $X_{24}$.

In certain embodiments, the present invention provides an isolated polypeptide, comprising the amino acid sequence of SEQ ID NO: 202: $HX_2EGTFTX_8X_9X_{10}S$-$X_{12}QX_{14}EX_{16}X_{17}X_{18}X_{19}X_{20}X_{21}FIX_{24}WLKX_{28}GGPX_{32}S$ GAPPPS-(OH/NH$_2$) (SEQ ID NO: 202) or a pharmaceutically acceptable salt thereof, wherein:

$X_2$ is 2-aminoisobutyric acid (Aib) or G;
$X_8$ is N or S;
$X_9$ is D or E;
$X_{10}$ is I, L, or V;
$X_{12}$ is E or K;
$X_{14}$ is M or Y;
$X_{16}$ is Dap, E, or K;
$X_{17}$ is E or K;
$X_{18}$ is A or Y;
$X_{19}$ is A or V;
$X_{20}$ is E, K, or R;
$X_{21}$ is E, K, L, or Q;
$X_{24}$ is E, K, or S;
$X_{28}$ is E, K, N, or Q; and
$X_{32}$ is H or S;

wherein when $X_{16}$ is Dap or K, it is covalently bound to a lipophilic substituent, optionally via a spacer;

wherein when $X_{16}$ is E, at least one of $X_{17}$, $X_{20}$, or $X_{21}$ is selected to be lysine wherein the lysine residue is covalently bound to a lipophilic substituent, optionally via a spacer; and wherein the peptide optionally further comprises a lactam bridge formed via an amide bond between the side chains of a lysine and a glutamic acid at positions $X_{17}$ and $X_{21}$, respectively; at positions $X_{21}$ and $X_{17}$, respectively; at positions $X_{21}$ and $X_{28}$, respectively; at positions $X_{28}$ and $X_{21}$, respectively; at positions $X_{20}$ and $X_{24}$, respectively; at positions $X_{24}$ and $X_{20}$, respectively; or at positions $X_{12}$ and $X_{16}$, respectively.

In some embodiments, $X_2$ is Aib.
In some embodiments, if $X_{24}$ is S, then $X_{10}$ is V.
In some embodiments, $X_{14}$ is Y.
In some embodiments, $X_{14}$ is M, and $X_{16}$ is K covalently bound to a lipophilic substituent, optionally via a spacer.

In some embodiments, $X_{16}$ is K covalently bound to a lipophilic substituent, optionally via a spacer.

In some embodiments, if $X_{16}$ is E, then $X_{21}$ is K or E. In some embodiments, if $X_{16}$ is E, then $X_{21}$ is K. In some embodiments, if $X_{16}$ is E, then $X_{21}$ is E.

In some embodiments, the peptide further comprises a lactam bridge formed via an amide bond between the side chains of a lysine and a glutamic acid at positions $X_{20}$ and $X_{24}$, respectively.

In some embodiments, $X_2$ is Aib. In some embodiments, $X_2$ is G.

In some embodiments, $X_8$ is N. In some embodiments, $X_8$ is S.

In some embodiments, $X_9$ is D. In some embodiments, $X_9$ is E.

In some embodiments, $X_{10}$ is I. In some embodiments, $X_{10}$ is L. In some embodiments, $X_{10}$ is V.

In some embodiments, $X_{12}$ is E. In some embodiments, $X_{12}$ is K.

In some embodiments, $X_{14}$ is M. In some embodiments, $X_{14}$ is Y.

In some embodiments, $X_{16}$ is Dap covalently bound to a lipophilic substituent, optionally via a spacer. In some embodiments, $X_{16}$ is K covalently bound to a lipophilic substituent, optionally via a spacer. In some embodiments, $X_{16}$ is E, and at least one of $X_{17}$, $X_{20}$, or $X_{21}$ is selected to be lysine wherein the lysine residue is covalently bound to a lipophilic substituent, optionally via a spacer.

In some embodiments, $X_{17}$ is E. In some embodiments, $X_{17}$ is K.

In some embodiments, $X_{18}$ is A. In some embodiments, $X_{18}$ is Y.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is E. In some embodiments, $X_{21}$ is K. In some embodiments, $X_{21}$ is L. In some embodiments, $X_{21}$ is Q.

In some embodiments, $X_{24}$ is E. In some embodiments, $X_{24}$ is K. In some embodiments, $X_{24}$ is S.

In some embodiments, $X_{28}$ is E. In some embodiments, $X_{28}$ is K. In some embodiments, $X_{28}$ is N. In some embodiments, $X_{28}$ is Q.

In some embodiments, $X_{32}$ is H. In some embodiments, $X_{32}$ is S.

In some embodiments, carboxy terminal amino acid, i.e. Sc, is —$S_{39}$—($NH_2$). In some embodiments, carboxy terminal amino acid $S_{39}$ is —$S_{39}$—(OH).

In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{17}$ and $X_{21}$, respectively. In some embodiments, the isolated peptide further comprises a lactam bridge formed via an amide bond between the side chains of a lysine and a glutamic acid at positions $X_{21}$ and $X_{28}$, respectively. In some embodiments, the isolated peptide further comprises a lactam bridge formed via an amide bond between the side chains of a lysine and a glutamic acid at positions $X_{28}$ and $X_{21}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively. In some embodiments, the isolated peptide further comprises a lactam bridge formed via an amide bond between the side chains of a lysine and a glutamic acid at positions $X_{12}$ and $X_{16}$, respectively. In some embodiments, the isolated peptide further comprises a lactam bridge formed via an amide bond between the side chains of a lysine and a glutamic acid at positions $X_{16}$ and $X_{12}$, respectively.

In some embodiments, when K is selected at position $X_{12}$, $X_{17}$, $X_{20}$, $X_{21}$, $X_{24}$, or $X_{28}$, it represents lysine optionally covalently bound to a lipophilic substituent, optionally via a spacer.

In some embodiments, when K is selected at position $X_{17}$, $X_{20}$, or $X_{21}$, it represents lysine optionally covalently bound to a lipophilic substituent, optionally via a spacer.

In some embodiments, only the residue at $X_{16}$ may be covalently bound to a lipophilic substituent, optionally via a spacer.

In certain embodiments, the present invention provides an isolated polypeptide, comprising the amino acid sequence of SEQ ID NO: 203: HX$_2$EGTFTX$_8$X$_9$X$_{10}$SX$_{12}$QYEX$_{16}$X$_{17}$X$_{18}$X$_{19}$X$_{20}$X$_{21}$FIX$_{24}$WLKX$_{28}$GGPX$_{32}$SGAPPPS-(OH/NH$_2$) (SEQ ID NO: 203) or a pharmaceutically acceptable salt thereof, wherein:
$X_2$ is 2-aminoisobutyric acid (Aib) or G;
$X_8$ is N or S;
$X_9$ is D or E;
$X_{10}$ is I, L, or V;
$X_{12}$ is E or K;
$X_{16}$ is K covalently bound to a lipophilic substituent, optionally via a spacer;
$X_{17}$ is E or K;
$X_{18}$ is A or Y;
$X_{19}$ is A or V;
$X_{20}$ is E, K, or R;
$X_{21}$ is E, K, L, or Q;
$X_{24}$ is E, K, or S;
$X_{28}$ is E, K, N, or Q; and
$X_{32}$ is H or S;
each K independently represents lysine optionally covalently bound to a lipophilic substituent, optionally via a spacer;
wherein the peptide optionally further comprises a lactam bridge formed via an amide bond between the side chains of a lysine and a glutamic acid at positions $X_{17}$ and $X_{21}$, respectively; at positions $X_{21}$ and $X_{17}$, respectively; at positions $X_{21}$ and $X_{28}$, respectively; at positions $X_{28}$ and $X_{21}$, respectively; at positions $X_{20}$ and $X_{24}$, respectively; or at positions $X_{24}$ and $X_{20}$, respectively.

In some embodiments, $X_2$ is Aib.

In some embodiments, if $X_{24}$ is S, then $X_{10}$ is V.

In some embodiments, the peptide comprises a lactam bridge formed via an amide bond between the side chains of a lysine and a glutamic acid at positions $X_{20}$ and $X_{24}$, respectively.

In some embodiments, $X_2$ is Aib. In some embodiments, $X_2$ is G.

In some embodiments, $X_8$ is N. In some embodiments, $X_8$ is S.

In some embodiments, $X_9$ is D. In some embodiments, $X_9$ is E.

In some embodiments, $X_{10}$ is I. In some embodiments, $X_{10}$ is L. In some embodiments, $X_{10}$ is V.

In some embodiments, $X_{12}$ is E. In some embodiments, $X_{12}$ is K.

In some embodiments, $X_{17}$ is E. In some embodiments, $X_{17}$ is K.

In some embodiments, $X_{18}$ is A. In some embodiments, $X_{18}$ is Y.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is E. In some embodiments, $X_{21}$ is K. In some embodiments, $X_{21}$ is L. In some embodiments, $X_{21}$ is Q.

In some embodiments, $X_{24}$ is E. In some embodiments, $X_{24}$ is K. In some embodiments, $X_{24}$ is S.

In some embodiments, $X_{28}$ is E. In some embodiments, $X_{28}$ is K. In some embodiments, $X_{28}$ is N. In some embodiments, $X_{28}$ is Q.

In some embodiments, $X_{32}$ is H. In some embodiments, $X_{32}$ is S.

In some embodiments, carboxy terminal amino acid, i.e. Sc, is —$S_{39}$—($NH_2$). In some embodiments, carboxy terminal amino acid $S_{39}$ is —$S_{39}$—(OH).

In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{17}$ and $X_{21}$, respectively. In some embodiments, the isolated peptide further comprises a lactam bridge formed via an amide bond between the side chains of a lysine and a glutamic acid at positions $X_{21}$ and $X_{28}$, respectively. In some embodiments, the isolated peptide further comprises a lactam bridge formed via an amide bond between the side chains of a lysine and a glutamic acid at positions $X_{28}$ and $X_{21}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively.

In some embodiments, when K is selected at position $X_{12}$, $X_{17}$, $X_{20}$, $X_{21}$, $X_{24}$, or $X_{28}$, it represents lysine optionally covalently bound to a lipophilic substituent, optionally via a spacer.

In some embodiments, when K is selected at position $X_{17}$, $X_{20}$, or $X_{21}$, it represents lysine optionally covalently bound to a lipophilic substituent, optionally via a spacer.

In some embodiments, only the residue at $X_{16}$ is covalently bound to a lipophilic substituent, optionally via a spacer.

In some embodiments, certain amino acids represented by the consensus sequence of SEQ ID NO: 202 or SEQ ID NO: 203 include the following:

In some embodiments, $X_2$ is Aib and $X_{10}$ is V. In some embodiments, $X_2$ is Aib and $X_{14}$ is Y. In some embodiments, $X_2$ is Aib and $X_{16}$ is K covalently bound to a lipophilic substituent, optionally via a spacer. In some embodiments, $X_2$ is Aib and $X_{19}$ is V. In some embodiments, $X_2$ is Aib and $X_{19}$ is A. In some embodiments, $X_2$ is Aib and $X_{20}$ is R. In some embodiments, $X_2$ is Aib and $X_{20}$ is K. In some embodiments, $X_2$ is Aib and $X_{21}$ is K. In some embodiments, $X_2$ is Aib and $X_{21}$ is Q. In some embodiments, $X_2$ is Aib and $X_{24}$ is S. In some embodiments, $X_2$ is Aib and $X_{24}$ is E.

In some embodiments, $X_{10}$ is V and $X_{14}$ is Y. In some embodiments, $X_{10}$ is V and $X_{16}$ is K covalently bound to a lipophilic substituent, optionally via a spacer. In some embodiments, $X_{10}$ is V and $X_{19}$ is V. In some embodiments, $X_{10}$ is V and $X_{19}$ is A. In some embodiments, $X_{10}$ is V and $X_{20}$ is R. In some embodiments, $X_{10}$ is V and $X_{20}$ is K. In some embodiments, $X_{10}$ is V and $X_{21}$ is K. In some embodiments, $X_{10}$ is V and $X_{21}$ is Q. In some embodiments, $X_{10}$ is V and $X_{24}$ is S. In some embodiments, $X_{10}$ is V and $X_{24}$ is E.

In some embodiments, $X_{14}$ is Y and $X_{16}$ is K covalently bound to a lipophilic substituent, optionally via a spacer. In some embodiments, $X_{14}$ is Y and $X_{19}$ is V. In some embodiments, $X_{14}$ is Y and $X_{19}$ is A. In some embodiments, $X_{14}$ is Y and $X_{20}$ is R. In some embodiments, $X_{14}$ is Y and $X_{20}$ is K. In some embodiments, $X_{14}$ is Y and $X_{21}$ is K. In some embodiments, $X_{14}$ is Y and $X_{21}$ is Q. In some embodiments, $X_{14}$ is Y and $X_{24}$ is S. In some embodiments, $X_{14}$ is Y and $X_{24}$ is E.

In some embodiments, $X_{16}$ is K covalently bound to a lipophilic substituent, optionally via a spacer, and $X_{19}$ is V. In some embodiments, $X_{16}$ is K covalently bound to a lipophilic substituent, optionally via a spacer, and $X_{19}$ is A. In some embodiments, $X_{16}$ is K covalently bound to a lipophilic substituent, optionally via a spacer, and $X_{20}$ is R. In some embodiments, $X_{16}$ is K covalently bound to a lipophilic substituent, optionally via a spacer, and $X_{20}$ is K. In some embodiments, $X_{16}$ is K covalently bound to a lipophilic substituent, optionally via a spacer, and $X_{21}$ is K. In some embodiments, $X_{16}$ is K covalently bound to a lipophilic substituent, optionally via a spacer, and $X_{21}$ is Q. In some embodiments, $X_{16}$ is K covalently bound to a lipophilic substituent, optionally via a spacer, and $X_{24}$ is S. In some embodiments, $X_{16}$ is K covalently bound to a lipophilic substituent, optionally via a spacer, and $X_{24}$ is E.

In some embodiments, $X_{19}$ is V and $X_{20}$ is R. In some embodiments, $X_{19}$ is V and $X_{20}$ is K. In some embodiments, $X_{19}$ is V and $X_{21}$ is K. In some embodiments, $X_{19}$ is V and $X_{21}$ is Q. In some embodiments, $X_{19}$ is V and $X_{24}$ is S. In some embodiments, $X_{19}$ is V and $X_{24}$ is E.

In some embodiments, $X_{19}$ is A and $X_{20}$ is R. In some embodiments, $X_{19}$ is A and $X_{20}$ is K. In some embodiments, $X_{19}$ is A and $X_{21}$ is K. In some embodiments, $X_{19}$ is A and $X_{21}$ is Q. In some embodiments, $X_{19}$ is A and $X_{24}$ is S. In some embodiments, $X_{19}$ is A and $X_{24}$ is E.

In some embodiments, $X_{20}$ is R and $X_{21}$ is K. In some embodiments, $X_{20}$ is R and $X_{21}$ is Q. In some embodiments, $X_{20}$ is R and $X_{24}$ is S. In some embodiments, $X_{20}$ is R and $X_{24}$ is E.

In some embodiments, $X_{20}$ is K and $X_{21}$ is K. In some embodiments, $X_{20}$ is K and $X_{21}$ is Q. In some embodiments, $X_{20}$ is K and $X_{24}$ is S. In some embodiments, $X_{20}$ is K and $X_{24}$ is E. In some embodiments, $X_{20}$ is K, $X_{24}$ is E, and the peptide comprises a lactam bridge formed via an amide bond between the side chains of $X_{20}$ and $X_{24}$.

In some embodiments, $X_{21}$ is K and $X_{24}$ is S. In some embodiments, $X_{21}$ is K and $X_{24}$ is E.

In some embodiments, $X_{21}$ is Q and $X_{24}$ is S. In some embodiments, $X_{21}$ is Q and $X_{24}$ is E.

In some embodiments, certain amino acids represented by the consensus sequence of SEQ ID NO: 202 or SEQ ID NO: 203 include the following:

In some embodiments, $X_2$ is Aib, $X_{10}$ is V, and $X_{14}$ is Y. In some embodiments, $X_2$ is Aib, $X_{10}$ is V, and $X_{16}$ is K covalently bound to a lipophilic substituent, optionally via a spacer. In some embodiments, $X_2$ is Aib, $X_{10}$ is V, and $X_{19}$ is V. In some embodiments, $X_2$ is Aib, $X_{10}$ is V, and $X_{19}$ is A. In some embodiments, $X_2$ is Aib, $X_{10}$ is V, and $X_{20}$ is R. In some embodiments, $X_2$ is Aib, $X_{10}$ is V, and $X_{20}$ is K. In some embodiments, $X_2$ is Aib, $X_{10}$ is V, and $X_{21}$ is K. In some embodiments, $X_2$ is Aib, $X_{10}$ is V, and $X_{21}$ is Q. In some embodiments, $X_2$ is Aib, $X_{10}$ is V, and $X_{24}$ is S. In some embodiments, $X_2$ is Aib, $X_{10}$ is V, and $X_{24}$ is E.

In some embodiments, $X_2$ is Aib, $X_{14}$ is Y, and $X_{16}$ is K covalently bound to a lipophilic substituent, optionally via a spacer. In some embodiments, $X_2$ is Aib, $X_{14}$ is Y, and $X_{19}$ is V. In some embodiments, $X_2$ is Aib, $X_{14}$ is Y, and $X_{19}$ is A. In some embodiments, $X_2$ is Aib, $X_{14}$ is Y, and $X_{20}$ is R. In some embodiments, $X_2$ is Aib, $X_{14}$ is Y, and $X_{20}$ is K. In some embodiments, $X_2$ is Aib, $X_{14}$ is Y, and $X_{21}$ is K. In some embodiments, $X_2$ is Aib, $X_{14}$ is Y, and $X_{21}$ is Q. In some embodiments, $X_2$ is Aib, $X_{14}$ is Y, and $X_{24}$ is S. In some embodiments, $X_2$ is Aib, $X_{14}$ is Y, and $X_{24}$ is E.

In some embodiments, $X_{10}$ is V, $X_{14}$ is Y, and $X_{16}$ is K covalently bound to a lipophilic substituent, optionally via a spacer. In some embodiments, $X_{10}$ is V, $X_{14}$ is Y, and $X_{19}$ is V. In some embodiments, $X_{10}$ is V, $X_{14}$ is Y, and $X_{19}$ is A. In some embodiments, $X_{10}$ is V, $X_{14}$ is Y, and $X_{20}$ is R. In some embodiments, $X_{10}$ is V, $X_{14}$ is Y, and $X_{20}$ is K. In some embodiments, $X_{10}$ is V, $X_{14}$ is Y, and $X_{21}$ is K. In some embodiments, $X_{10}$ is V, $X_{14}$ is Y, and $X_{21}$ is Q. In some embodiments, $X_{10}$ is V, $X_{14}$ is Y, and $X_{24}$ is S. In some embodiments, $X_{10}$ is V, $X_{14}$ is Y, and $X_{24}$ is E.

In some embodiments, $X_{14}$ is Y; $X_{16}$ is K covalently bound to a lipophilic substituent, optionally via a spacer; and $X_{19}$ is V. In some embodiments, $X_{14}$ is Y; $X_{16}$ is K covalently bound to a lipophilic substituent, optionally via a spacer; and $X_{19}$ is A. In some embodiments, $X_{14}$ is Y; $X_{16}$ is K covalently bound to a lipophilic substituent, optionally via a spacer; and $X_{20}$ is R. In some embodiments, $X_{14}$ is Y; $X_{16}$ is K covalently bound to a lipophilic substituent, optionally via a spacer; and $X_{20}$ is K. In some embodiments, $X_{14}$ is Y; $X_{16}$ is K covalently bound to a lipophilic substituent, optionally via a spacer; and $X_{21}$ is K. In some embodiments, $X_{14}$ is Y; $X_{16}$ is K covalently bound to a lipophilic substituent, optionally via a spacer; and $X_{21}$ is Q. In some embodiments, $X_{14}$ is Y; $X_{16}$ is K covalently bound to a lipophilic substituent, optionally via a spacer; and $X_{24}$ is S. In some embodiments, $X_{14}$ is Y; $X_{16}$ is K covalently bound to a lipophilic substituent, optionally via a spacer; and $X_{24}$ is E.

In some embodiments, $X_{14}$ is Y, $X_{19}$ is V, and $X_{21}$ is K. In some embodiments, $X_{14}$ is Y, $X_{19}$ is A, and $X_{21}$ is K. In some embodiments, $X_{14}$ is Y, $X_{20}$ is R, and $X_{21}$ is K. In some embodiments, $X_{14}$ is Y, $X_{20}$ is K, and $X_{21}$ is K. In some embodiments, $X_{14}$ is Y, $X_{21}$ is K, and $X_{24}$ is S. In some embodiments, $X_{14}$ is Y, $X_{21}$ is K, and $X_{24}$ is E.

In some embodiments, $X_{16}$ is K covalently bound to a lipophilic substituent, optionally via a spacer; $X_{19}$ is A; and $X_{20}$ is R. In some embodiments, $X_{16}$ is K covalently bound to a lipophilic substituent, optionally via a spacer; $X_{19}$ is A; and $X_{20}$ is K. In some embodiments, $X_{16}$ is K covalently bound to a lipophilic substituent, optionally via a spacer; $X_{19}$ is A; and $X_{21}$ is K. In some embodiments, $X_{16}$ is K covalently bound to a lipophilic substituent, optionally via a spacer; $X_{19}$ is A; and $X_{21}$ is Q. In some embodiments, $X_{16}$ is K covalently bound to a lipophilic substituent, optionally via a spacer; $X_{19}$ is A; and $X_{24}$ is S. In some embodiments, $X_{16}$ is K covalently bound to a lipophilic substituent, optionally via a spacer; $X_{19}$ is A; and $X_{24}$ is E.

In some embodiments, $X_{19}$ is V, $X_{20}$ is R, and $X_{21}$ is K. In some embodiments, $X_{19}$ is V, $X_{20}$ is R, and $X_{21}$ is Q. In some embodiments, $X_{19}$ is V, $X_{20}$ is R, and $X_{24}$ is S. In some embodiments, $X_{19}$ is V, $X_{20}$ is R, and $X_{24}$ is E.

In some embodiments, $X_{19}$ is A, $X_{20}$ is R, and $X_{21}$ is K. In some embodiments, $X_{19}$ is A, $X_{20}$ is R, and $X_{21}$ is Q. In some embodiments, $X_{19}$ is A, $X_{20}$ is R, and $X_{24}$ is S. In some embodiments, $X_{19}$ is A, $X_{20}$ is R, and $X_{24}$ is E.

In some embodiments, $X_{20}$ is R, $X_{21}$ is K, and $X_{24}$ is S. In some embodiments, $X_{20}$ is R, $X_{21}$ is K, and $X_{24}$ is E.

In some embodiments, $X_{20}$ is K, $X_{21}$ is K, and $X_{24}$ is S. In some embodiments, $X_{20}$ is K, $X_{21}$ is K, and $X_{24}$ is E. In some embodiments, $X_{20}$ is K, $X_{21}$ is K, $X_{24}$ is E, and the peptide comprises a lactam bridge formed via an amide bond between the side chains of $X_{20}$ and $X_{24}$.

In certain embodiments, the present invention provides an isolated polypeptide, comprising the amino acid sequence of SEQ ID NO: 204: HX$_2$EGTFTX$_8$DX$_{10}$SX$_{12}$QX$_{14}$EX$_{16}$X$_{17}$X$_{18}$X$_{19}$X$_{20}$X$_{21}$FIX$_{24}$WLKX$_{28}$GGPX$_{32}$SGAPPPS-(OH/NH$_2$) (SEQ ID NO: 204), or a pharmaceutically acceptable salt thereof, wherein:

$X_2$ is 2-aminoisobutyric acid (Aib) or G;
$X_8$ is N or S;
$X_{10}$ is I, L, or V;
$X_{12}$ is E, K, or Q;
$X_{14}$ is M or Y;
$X_{16}$ is (diaminopimelic acid) Dap covalently bound to a lipophilic substituent, optionally via a spacer, or K covalently bound to a lipophilic substituent, optionally via a spacer;
$X_{17}$ is E or K;
$X_{18}$ is A or Y;
$X_{19}$ is A or V;
$X_{20}$ is E, K, or R;
$X_{21}$ is E, K, L, or Q;
$X_{24}$ is E, K, or S;
$X_{28}$ is N or Q; and
$X_{32}$ is H or S;
wherein the peptide optionally comprises a lactam bridge formed via an amide bond between the side chains of a lysine and a glutamic acid at positions $X_{17}$ and $X_{21}$, respectively; at positions $X_{21}$ and $X_{17}$, respectively; at positions $X_{20}$ and $X_{24}$, respectively; or at positions $X_{24}$ and $X_{20}$, respectively.

In some embodiments, $X_2$ is Aib.
In some embodiments, if $X_{24}$ is S, then $X_{10}$ is V.
In some embodiments, $X_{14}$ is Y.

In some embodiments, $X_{14}$ is M, and $X_{16}$ is K covalently bound to a lipophilic substituent, optionally via a spacer.

In some embodiments, $X_{16}$ is K covalently bound to a lipophilic substituent, optionally via a spacer.

In some embodiments, the peptide comprises a lactam bridge formed via an amide bond between the side chains of a lysine and a glutamic acid at positions $X_{20}$ and $X_{24}$, respectively.

In some embodiments, $X_2$ is Aib. In some embodiments, $X_2$ is G.

In some embodiments, $X_8$ is N. In some embodiments, $X_8$ is S.

In some embodiments, $X_{10}$ is I. In some embodiments, $X_{10}$ is L. In some embodiments, $X_{10}$ is V.

In some embodiments, $X_{12}$ is E. In some embodiments, $X_{12}$ is K. In some embodiments, $X_{12}$ is Q.

In some embodiments, $X_{14}$ is M. In some embodiments, $X_{14}$ is Y.

In some embodiments, $X_{16}$ is Dap covalently bound to a lipophilic substituent, optionally via a spacer. In some embodiments, $X_{16}$ is K covalently bound to a lipophilic substituent, optionally via a spacer.

In some embodiments, $X_{17}$ is E. In some embodiments, $X_{17}$ is K.

In some embodiments, $X_{18}$ is A. In some embodiments, $X_{18}$ is Y.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is E. In some embodiments, $X_{21}$ is K. In some embodiments, $X_{21}$ is L. In some embodiments, $X_{21}$ is Q.

In some embodiments, $X_{24}$ is E. In some embodiments, $X_{24}$ is K. In some embodiments, $X_{24}$ is S.

In some embodiments, $X_{28}$ is N. In some embodiments, $X_{28}$ is Q.

In some embodiments, $X_{32}$ is H. In some embodiments, $X_{32}$ is S.

In some embodiments, carboxy terminal amino acid, i.e. Sc, is —S$_{39}$—(NH$_2$). In some embodiments, carboxy terminal amino acid S$_{39}$ is —S$_{39}$—(OH).

In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{17}$ and $X_{21}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively.

In some embodiments, when K is selected at position $X_{12}$, $X_{17}$, $X_{20}$, $X_{21}$, or $X_{24}$, it represents lysine optionally covalently bound to a lipophilic substituent, optionally via a spacer.

In some embodiments, when K is selected at position $X_{17}$, $X_{20}$, or $X_{21}$, it represents lysine optionally covalently bound to a lipophilic substituent, optionally via a spacer.

In some embodiments, only the residue at $X_{16}$ is covalently bound to a lipophilic substituent, optionally via a spacer.

In certain embodiments, the present invention provides an isolated polypeptide, comprising the amino acid sequence of SEQ ID NO: 205: $HX_2EGTFTX_8DX_{10}SX_{12}QYEX_{16}X_{17}X_{18}X_{19}X_{20}X_{21}FIX_{24}WLKX_{28}GGPX_{32}SGAPPPS-(OH/NH_2)$ (SEQ ID NO: 205), or a pharmaceutically acceptable salt thereof, wherein:

$X_2$ is 2-aminoisobutyric acid (Aib) or G;
$X_8$ is N or S;
$X_{10}$ is I, L, or V;
$X_{12}$ is E, K, or Q;
$X_{16}$ is K covalently bound to a lipophilic substituent, optionally via a spacer;
$X_{17}$ is E or K;
$X_{18}$ is A or Y;
$X_{19}$ is A or V;
$X_{20}$ is E, K, or R;
$X_{21}$ is E, K, L, or Q;
$X_{24}$ is E, K, or S;
$X_{28}$ is N or Q; and
$X_{32}$ is H or S;
wherein the peptide optionally further comprises a lactam bridge formed via an amide bond between the side chains of a lysine and a glutamic acid at positions $X_{17}$ and $X_{21}$, respectively; at positions $X_{21}$ and $X_{17}$, respectively; at positions $X_{20}$ and $X_{24}$, respectively; or at positions $X_{24}$ and $X_{20}$, respectively.

In some embodiments, $X_2$ is Aib.

In some embodiments, if $X_{24}$ is S, then $X_{10}$ is V.

In some embodiments, the peptide comprises a lactam bridge formed via an amide bond between the side chains of a lysine and a glutamic acid at positions $X_{20}$ and $X_{24}$, respectively.

In some embodiments, $X_2$ is Aib. In some embodiments, $X_2$ is G.

In some embodiments, $X_8$ is N. In some embodiments, $X_8$ is S.

In some embodiments, $X_{10}$ is I. In some embodiments, $X_{10}$ is L. In some embodiments, $X_{10}$ is V.

In some embodiments, $X_{12}$ is E. In some embodiments, $X_{12}$ is K. In some embodiments, $X_{12}$ is Q.

In some embodiments, $X_{17}$ is E. In some embodiments, $X_{17}$ is K.

In some embodiments, $X_{18}$ is A. In some embodiments, $X_{18}$ is Y.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is E. In some embodiments, $X_{21}$ is K. In some embodiments, $X_{21}$ is L. In some embodiments, $X_{21}$ is Q.

In some embodiments, $X_{24}$ is E. In some embodiments, $X_{24}$ is K. In some embodiments, $X_{24}$ is S.

In some embodiments, $X_{28}$ is N. In some embodiments, $X_{28}$ is Q.

In some embodiments, $X_{32}$ is H. In some embodiments, $X_{32}$ is S.

In some embodiments, carboxy terminal amino acid, i.e. Sc, is —$S_{39}$—($NH_2$). In some embodiments, carboxy terminal amino acid $S_{39}$ is —$S_{39}$—(OH).

In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{17}$ and $X_{21}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively.

In some embodiments, when K is selected at position $X_{12}$, $X_{17}$, $X_{20}$, $X_{21}$, or $X_{24}$, it represents lysine optionally covalently bound to a lipophilic substituent, optionally via a spacer.

In some embodiments, when K is selected at position $X_{17}$, $X_{20}$, or $X_{21}$, it represents lysine optionally covalently bound to a lipophilic substituent, optionally via a spacer.

In some embodiments, only the residue at $X_{16}$ is covalently bound to a lipophilic substituent, optionally via a spacer.

In some embodiments, certain amino acids represented by the consensus sequence of SEQ ID NO: 204 or SEQ ID NO: 205 include the following:

In some embodiments, $X_2$ is Aib and $X_{10}$ is V. In some embodiments, $X_2$ is Aib and $X_{14}$ is Y. In some embodiments, $X_2$ is Aib and $X_{16}$ is K covalently bound to a lipophilic substituent, optionally via a spacer. In some embodiments, $X_2$ is Aib and $X_{19}$ is V. In some embodiments, $X_2$ is Aib and $X_{19}$ is A. In some embodiments, $X_2$ is Aib and $X_{20}$ is R. In some embodiments, $X_2$ is Aib and $X_{20}$ is K. In some embodiments, $X_2$ is Aib and $X_{21}$ is K. In some embodiments, $X_2$ is Aib and $X_{21}$ is Q. In some embodiments, $X_2$ is Aib and $X_{24}$ is S. In some embodiments, $X_2$ is Aib and $X_{24}$ is E.

In some embodiments, $X_{10}$ is V and $X_{14}$ is Y. In some embodiments, $X_{10}$ is V and $X_{16}$ is K covalently bound to a lipophilic substituent, optionally via a spacer. In some embodiments, $X_{10}$ is V and $X_{19}$ is V. In some embodiments, $X_{10}$ is V and $X_{19}$ is A. In some embodiments, $X_{10}$ is V and $X_{20}$ is R. In some embodiments, $X_{10}$ is V and $X_{20}$ is K. In some embodiments, $X_{10}$ is V and $X_{21}$ is K. In some embodiments, $X_{10}$ is V and $X_{21}$ is Q. In some embodiments, $X_{10}$ is V and $X_{24}$ is S. In some embodiments, $X_{10}$ is V and $X_{24}$ is E.

In some embodiments, $X_{14}$ is Y and $X_{16}$ is K covalently bound to a lipophilic substituent, optionally via a spacer. In some embodiments, $X_{14}$ is Y and $X_{19}$ is V. In some embodiments, $X_{14}$ is Y and $X_{19}$ is A. In some embodiments, $X_{14}$ is Y and $X_{20}$ is R. In some embodiments, $X_{14}$ is Y and $X_{20}$ is K. In some embodiments, $X_{14}$ is Y and $X_{21}$ is K. In some embodiments, $X_{14}$ is Y and $X_{21}$ is Q. In some embodiments, $X_{14}$ is Y and $X_{24}$ is S. In some embodiments, $X_{14}$ is Y and $X_{24}$ is E.

In some embodiments, $X_{16}$ is K covalently bound to a lipophilic substituent, optionally via a spacer, and $X_{19}$ is V. In some embodiments, $X_{16}$ is K covalently bound to a lipophilic substituent, optionally via a spacer, and $X_{19}$ is A. In some embodiments, $X_{16}$ is K covalently bound to a lipophilic substituent, optionally via a spacer, and $X_{20}$ is R. In some embodiments, $X_{16}$ is K covalently bound to a lipophilic substituent, optionally via a spacer, and $X_{20}$ is K. In some embodiments, $X_{16}$ is K covalently bound to a lipophilic substituent, optionally via a spacer, and $X_{21}$ is K. In some embodiments, $X_{16}$ is K covalently bound to a lipophilic substituent, optionally via a spacer, and $X_{21}$ is Q. In some embodiments, $X_{16}$ is K covalently bound to a lipophilic substituent, optionally via a spacer, and $X_{24}$ is S. In some embodiments, $X_{16}$ is K covalently bound to a lipophilic substituent, optionally via a spacer, and $X_{24}$ is E.

In some embodiments, $X_{19}$ is V and $X_{20}$ is R. In some embodiments, $X_{19}$ is V and $X_{20}$ is K. In some embodiments, $X_{19}$ is V and $X_{21}$ is K. In some embodiments, $X_{19}$ is V and $X_{21}$ is Q. In some embodiments, $X_{19}$ is V and $X_{24}$ is S. In some embodiments, $X_{19}$ is V and $X_{24}$ is E.

In some embodiments, $X_{19}$ is A and $X_{20}$ is R. In some embodiments, $X_{19}$ is A and $X_{20}$ is K. In some embodiments, $X_{19}$ is A and $X_{21}$ is K. In some embodiments, $X_{19}$ is A and $X_{21}$ is Q. In some embodiments, $X_{19}$ is A and $X_{24}$ is S. In some embodiments, $X_{19}$ is A and $X_{24}$ is E.

In some embodiments, $X_{20}$ is R and $X_{21}$ is K. In some embodiments, $X_{20}$ is R and $X_{21}$ is Q. In some embodiments, $X_{20}$ is R and $X_{24}$ is S. In some embodiments, $X_{20}$ is R and $X_{24}$ is E.

In some embodiments, $X_{20}$ is K and $X_{21}$ is K. In some embodiments, $X_{20}$ is K and $X_{21}$ is Q. In some embodiments, $X_{20}$ is K and $X_{24}$ is S. In some embodiments, $X_{20}$ is K and $X_{24}$ is E. In some embodiments, $X_{20}$ is K, $X_{24}$ is E, and the peptide comprises a lactam bridge formed via an amide bond between the side chains of $X_{20}$ and $X_{24}$.

In some embodiments, $X_{21}$ is K and $X_{24}$ is S. In some embodiments, $X_{21}$ is K and $X_{24}$ is E.

In some embodiments, $X_{21}$ is Q and $X_{24}$ is S. In some embodiments, $X_{21}$ is Q and $X_{24}$ is E.

In some embodiments, certain amino acids represented by the consensus sequence of SEQ ID NO: 204 or SEQ ID NO: 205 include the following:

In some embodiments, $X_2$ is Aib, $X_{10}$ is V, and $X_{14}$ is Y. In some embodiments, $X_2$ is Aib, $X_{10}$ is V, and $X_{16}$ is K covalently bound to a lipophilic substituent, optionally via a spacer. In some embodiments, $X_2$ is Aib, $X_{10}$ is V, and $X_{19}$ is V. In some embodiments, $X_2$ is Aib, $X_{10}$ is V, and $X_{19}$ is A. In some embodiments, $X_2$ is Aib, $X_{10}$ is V, and $X_{20}$ is R. In some embodiments, $X_2$ is Aib, $X_{10}$ is V, and $X_{20}$ is K. In some embodiments, $X_2$ is Aib, $X_{10}$ is V, and $X_{21}$ is K. In some embodiments, $X_2$ is Aib, $X_{10}$ is V, and $X_{21}$ is Q. In some embodiments, $X_2$ is Aib, $X_{10}$ is V, and $X_{24}$ is S. In some embodiments, $X_2$ is Aib, $X_{10}$ is V, and $X_{24}$ is E.

In some embodiments, $X_2$ is Aib, $X_{14}$ is Y, and $X_{16}$ is K covalently bound to a lipophilic substituent, optionally via a spacer. In some embodiments, $X_2$ is Aib, $X_{14}$ is Y, and $X_{19}$ is V. In some embodiments, $X_2$ is Aib, $X_{14}$ is Y, and $X_{19}$ is A. In some embodiments, $X_2$ is Aib, $X_{14}$ is Y, and $X_{20}$ is R. In some embodiments, $X_2$ is Aib, $X_{14}$ is Y, and $X_{20}$ is K. In some embodiments, $X_2$ is Aib, $X_{14}$ is Y, and $X_{21}$ is K. In some embodiments, $X_2$ is Aib, $X_{14}$ is Y, and $X_{21}$ is Q. In some embodiments, $X_2$ is Aib, $X_{14}$ is Y, and $X_{24}$ is S. In some embodiments, $X_2$ is Aib, $X_{14}$ is Y, and $X_{24}$ is E.

In some embodiments, $X_{10}$ is V, $X_{14}$ is Y, and $X_{16}$ is K covalently bound to a lipophilic substituent, optionally via a spacer. In some embodiments, $X_{10}$ is V, $X_{14}$ is Y, and $X_{19}$ is V. In some embodiments, $X_{10}$ is V, $X_{14}$ is Y, and $X_{19}$ is A. In some embodiments, $X_{10}$ is V, $X_{14}$ is Y, and $X_{20}$ is R. In some embodiments, $X_{10}$ is V, $X_{14}$ is Y, and $X_{20}$ is K. In some embodiments, $X_{10}$ is V, $X_{14}$ is Y, and $X_{21}$ is K. In some embodiments, $X_{10}$ is V, $X_{14}$ is Y, and $X_{21}$ is Q. In some embodiments, $X_{10}$ is V, $X_{14}$ is Y, and $X_{24}$ is S. In some embodiments, $X_{10}$ is V, $X_{14}$ is Y, and $X_{24}$ is E.

In some embodiments, $X_{14}$ is Y; $X_{16}$ is K covalently bound to a lipophilic substituent, optionally via a spacer; and $X_{19}$ is V. In some embodiments, $X_{14}$ is Y; $X_{16}$ is K covalently bound to a lipophilic substituent, optionally via a spacer; and $X_{19}$ is A. In some embodiments, $X_{14}$ is Y; $X_{16}$ is K covalently bound to a lipophilic substituent, optionally via a spacer; and $X_{20}$ is R. In some embodiments, $X_{14}$ is Y; $X_{16}$ is K covalently bound to a lipophilic substituent, optionally via a spacer; and $X_{20}$ is K. In some embodiments, $X_{14}$ is Y; $X_{16}$ is K covalently bound to a lipophilic substituent, optionally via a spacer; and $X_{21}$ is K. In some embodiments, $X_{14}$ is Y; $X_{16}$ is K covalently bound to a lipophilic substituent, optionally via a spacer; and $X_{21}$ is Q. In some embodiments, $X_{14}$ is Y; $X_{16}$ is K covalently bound to a lipophilic substituent, optionally via a spacer; and $X_{24}$ is S. In some embodiments, $X_{14}$ is Y; $X_{16}$ is K covalently bound to a lipophilic substituent, optionally via a spacer; and $X_{24}$ is E.

In some embodiments, $X_{14}$ is Y, $X_{19}$ is V, and $X_{21}$ is K. In some embodiments, $X_{14}$ is Y, $X_{19}$ is A, and $X_{21}$ is K. In some embodiments, $X_{14}$ is Y, $X_{20}$ is R, and $X_{21}$ is K. In some embodiments, $X_{14}$ is Y, $X_{20}$ is K, and $X_{21}$ is K. In some embodiments, $X_{14}$ is Y, $X_{21}$ is K, and $X_{24}$ is S. In some embodiments, $X_{14}$ is Y, $X_{21}$ is K, and $X_{24}$ is E.

In some embodiments, $X_{16}$ is K covalently bound to a lipophilic substituent, optionally via a spacer; $X_{19}$ is A; and $X_{20}$ is R. In some embodiments, $X_{16}$ is K covalently bound to a lipophilic substituent, optionally via a spacer; $X_{19}$ is A; and $X_{20}$ is K. In some embodiments, $X_{16}$ is K covalently bound to a lipophilic substituent, optionally via a spacer; $X_{19}$ is A; and $X_{21}$ is K. In some embodiments, $X_{16}$ is K covalently bound to a lipophilic substituent, optionally via a spacer; $X_{19}$ is A; and $X_{21}$ is Q. In some embodiments, $X_{16}$ is K covalently bound to a lipophilic substituent, optionally via a spacer; $X_{19}$ is A; and $X_{24}$ is S. In some embodiments, $X_{16}$ is K covalently bound to a lipophilic substituent, optionally via a spacer; $X_{19}$ is A; and $X_{24}$ is E.

In some embodiments, $X_{19}$ is V, $X_{20}$ is R, and $X_{21}$ is K. In some embodiments, $X_{19}$ is V, $X_{20}$ is R, and $X_{21}$ is Q. In some embodiments, $X_{19}$ is V, $X_{20}$ is R, and $X_{24}$ is S. In some embodiments, $X_{19}$ is V, $X_{20}$ is R, and $X_{24}$ is E.

In some embodiments, $X_{19}$ is A, $X_{20}$ is R, and $X_{21}$ is K. In some embodiments, $X_{19}$ is A, $X_{20}$ is R, and $X_{21}$ is Q. In some embodiments, $X_{19}$ is A, $X_{20}$ is R, and $X_{24}$ is S. In some embodiments, $X_{19}$ is A, $X_{20}$ is R, and $X_{24}$ is E.

In some embodiments, $X_{20}$ is R, $X_{21}$ is K, and $X_{24}$ is S. In some embodiments, $X_{20}$ is R, $X_{21}$ is K, and $X_{24}$ is E.

In some embodiments, $X_{20}$ is K, $X_{21}$ is K, and $X_{24}$ is S. In some embodiments, $X_{20}$ is K, $X_{21}$ is K, and $X_{24}$ is E. In some embodiments, $X_{20}$ is K, $X_{21}$ is K, $X_{24}$ is E, and the peptide comprises a lactam bridge formed via an amide bond between the side chains of $X_{20}$ and $X_{24}$.

In certain embodiments, the present invention provides an isolated polypeptide, comprising the amino acid sequence of SEQ ID NO: 206: HX$_2$EGTFTX$_8$DX$_{10}$SKQX$_{14}$EX$_{16}$EAX$_{19}$X$_{20}$X$_{21}$FIX$_{24}$WLKX$_{28}$GGPSSGAPPPS-(OH/NH$_2$) (SEQ ID NO: 206), or a pharmaceutically acceptable salt thereof, wherein:

$X_2$ is 2-aminoisobutyric acid (Aib) or G;
$X_8$ is N or S;
$X_{10}$ is I, L, or V;
$X_{14}$ is M or Y;
$X_{16}$ is K covalently bound to a lipophilic substituent, optionally via a spacer;
$X_{19}$ is A or V;
$X_{20}$ is E, K, or R;
$X_{21}$ is E, K, L, or Q;
$X_{24}$ is E, K, or S; and
$X_{28}$ is N or Q;
wherein the peptide optionally further comprises a lactam bridge formed via an amide bond between the side chains of a lysine and a glutamic acid at positions $X_{21}$ and $X_{17}$, respectively; at positions $X_{20}$ and $X_{24}$, respectively; or at positions $X_{24}$ and $X_{20}$, respectively.

In some embodiments, $X_2$ is Aib.
In some embodiments, if $X_{24}$ is S, then $X_{10}$ is V.
In some embodiments, $X_{14}$ is Y.

In some embodiments, the peptide comprises a lactam bridge formed via an amide bond between the side chains of a lysine and a glutamic acid at positions $X_{20}$ and $X_{24}$, respectively.

In some embodiments, $X_2$ is Aib. In some embodiments, $X_2$ is G.

In some embodiments, $X_8$ is N. In some embodiments, $X_8$ is S.

In some embodiments, $X_{10}$ is I. In some embodiments, $X_{10}$ is L. In some embodiments, $X_{10}$ is V.

In some embodiments, $X_{14}$ is M. In some embodiments, $X_{14}$ is Y.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is E. In some embodiments, $X_{21}$ is K. In some embodiments, $X_{21}$ is L. In some embodiments, $X_{21}$ is Q.

In some embodiments, $X_{24}$ is E. In some embodiments, $X_{24}$ is K. In some embodiments, $X_{24}$ is S.

In some embodiments, $X_{28}$ is N. In some embodiments, $X_{28}$ is Q.

In some embodiments, carboxy terminal amino acid, i.e. Sc, is —$S_{39}$—($NH_2$). In some embodiments, carboxy terminal amino acid $S_{39}$ is —$S_{39}$—(OH).

In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{17}$ and $X_{21}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively.

In some embodiments, when K is selected at position $X_{20}$, $X_{21}$, or $X_{24}$, it represents lysine optionally covalently bound to a lipophilic substituent, optionally via a spacer.

In some embodiments, when K is selected at position $X_{20}$ or $X_{21}$, it represents lysine optionally covalently bound to a lipophilic substituent, optionally via a spacer.

In some embodiments, only the residue at $X_{16}$ is covalently bound to a lipophilic substituent, optionally via a spacer.

In certain embodiments, the present invention provides an isolated polypeptide, comprising the amino acid sequence of SEQ ID NO: 207: $HX_2EGTFTX_8DX_{10}S$ $KQYEX_{16}EAX_{19}X_{20}X_{21}FIX_{24}WLKX_{28}GGPSSGAPPPS$-(OH/$NH_2$) (SEQ ID NO: 207), or a pharmaceutically acceptable salt thereof, wherein:

$X_2$ is 2-aminoisobutyric acid (Aib) or G;
$X_8$ is N or S;
$X_{10}$ is I, L, or V;
$X_{16}$ is K covalently bound to a lipophilic substituent, optionally via a spacer;
$X_{19}$ is A or V;
$X_{20}$ is E, K, or R;
$X_{21}$ is E, K, L, or Q;
$X_{24}$ is E, K, or S; and
$X_{28}$ is N or Q;
wherein the peptide optionally further comprises a lactam bridge formed via an amide bond between the side chains of a lysine and a glutamic acid at positions $X_{21}$ and $X_{17}$, respectively; at positions $X_{20}$ and $X_{24}$, respectively; or at positions $X_{24}$ and $X_{20}$, respectively.

In some embodiments, $X_2$ is Aib.

In some embodiments, if $X_{24}$ is S, then $X_{10}$ is V.

In some embodiments, the peptide comprises a lactam bridge formed via an amide bond between the side chains of a lysine and a glutamic acid at positions $X_{20}$ and $X_{24}$, respectively.

In some embodiments, $X_2$ is Aib. In some embodiments, $X_2$ is G.

In some embodiments, $X_8$ is N. In some embodiments, $X_8$ is S.

In some embodiments, $X_{10}$ is I. In some embodiments, $X_{10}$ is L. In some embodiments, $X_{10}$ is V.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is E. In some embodiments, $X_{21}$ is K. In some embodiments, $X_{21}$ is L. In some embodiments, $X_{21}$ is Q.

In some embodiments, $X_{24}$ is E. In some embodiments, $X_{24}$ is K. In some embodiments, $X_{24}$ is S.

In some embodiments, $X_{28}$ is N. In some embodiments, $X_{28}$ is Q.

In some embodiments, carboxy terminal amino acid, i.e. Sc, is —$S_{39}$—($NH_2$). In some embodiments, carboxy terminal amino acid $S_{39}$ is —$S_{39}$—(OH).

In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{17}$ and $X_{21}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively.

In some embodiments, when K is selected at position $X_{20}$, $X_{21}$, or $X_{24}$, it represents lysine optionally covalently bound to a lipophilic substituent, optionally via a spacer.

In some embodiments, when K is selected at position $X_{20}$ or $X_{21}$, it represents lysine optionally covalently bound to a lipophilic substituent, optionally via a spacer.

In some embodiments, only the residue at $X_{16}$ is covalently bound to a lipophilic substituent, optionally via a spacer.

In some embodiments, certain amino acids represented by the consensus sequence of SEQ ID NO: 206 or SEQ ID NO: 207 include the following:

In some embodiments, $X_2$ is Aib and $X_{10}$ is V. In some embodiments, $X_2$ is Aib and $X_{14}$ is Y. In some embodiments, $X_2$ is Aib and $X_{19}$ is V. In some embodiments, $X_2$ is Aib and $X_{19}$ is A. In some embodiments, $X_2$ is Aib and $X_{20}$ is R. In some embodiments, $X_2$ is Aib and $X_{20}$ is K. In some embodiments, $X_2$ is Aib and $X_{21}$ is K. In some embodiments, $X_2$ is Aib and $X_{21}$ is Q. In some embodiments, $X_2$ is Aib and $X_{24}$ is S. In some embodiments, $X_2$ is Aib and $X_{24}$ is E.

In some embodiments, $X_{10}$ is V and $X_{14}$ is Y. In some embodiments, $X_{10}$ is V and $X_{19}$ is V. In some embodiments, $X_{10}$ is V and $X_{19}$ is A. In some embodiments, $X_{10}$ is V and $X_{20}$ is R. In some embodiments, $X_{10}$ is V and $X_{20}$ is K. In some embodiments, $X_{10}$ is V and $X_{21}$ is K. In some embodiments, $X_{10}$ is V and $X_{21}$ is Q. In some embodiments, $X_{10}$ is V and $X_{24}$ is S. In some embodiments, $X_{10}$ is V and $X_{24}$ is E.

In some embodiments, $X_{14}$ is Y and $X_{19}$ is V. In some embodiments, $X_{14}$ is Y and $X_{19}$ is A. In some embodiments, $X_{14}$ is Y and $X_{20}$ is R. In some embodiments, $X_{14}$ is Y and $X_{20}$ is K. In some embodiments, $X_{14}$ is Y and $X_{21}$ is K. In some embodiments, $X_{14}$ is Y and $X_{21}$ is Q. In some embodiments, $X_{14}$ is Y and $X_{24}$ is S. In some embodiments, $X_{14}$ is Y and $X_{24}$ is E.

In some embodiments, $X_{19}$ is V and $X_{20}$ is R. In some embodiments, $X_{19}$ is V and $X_{20}$ is K. In some embodiments, $X_{19}$ is V and $X_{21}$ is K. In some embodiments, $X_{19}$ is V and $X_{21}$ is Q. In some embodiments, $X_{19}$ is V and $X_{24}$ is S. In some embodiments, $X_{19}$ is V and $X_{24}$ is E.

In some embodiments, $X_{19}$ is A and $X_{20}$ is R. In some embodiments, $X_{19}$ is A and $X_{20}$ is K. In some embodiments, $X_{19}$ is A and $X_{21}$ is K. In some embodiments, $X_{19}$ is A and $X_{21}$ is Q. In some embodiments, $X_{19}$ is A and $X_{24}$ is S. In some embodiments, $X_{19}$ is A and $X_{24}$ is E.

In some embodiments, $X_{20}$ is R and $X_{21}$ is K. In some embodiments, $X_{20}$ is R and $X_{21}$ is Q. In some embodiments, $X_{20}$ is R and $X_{24}$ is S. In some embodiments, $X_{20}$ is R and $X_{24}$ is E.

In some embodiments, $X_{20}$ is K and $X_{21}$ is K. In some embodiments, $X_{20}$ is K and $X_{21}$ is Q. In some embodiments, $X_{20}$ is K and $X_{24}$ is S. In some embodiments, $X_{20}$ is K and $X_{24}$ is E. In some embodiments, $X_{20}$ is K, $X_{24}$ is E, and the peptide comprises a lactam bridge formed via an amide bond between the side chains of $X_{20}$ and $X_{24}$.

In some embodiments, $X_{21}$ is K and $X_{24}$ is S. In some embodiments, $X_{21}$ is K and $X_{24}$ is E.

In some embodiments, $X_{21}$ is Q and $X_{24}$ is S. In some embodiments, $X_{21}$ is Q and $X_{24}$ is E.

In some embodiments, certain amino acids represented by the consensus sequence of SEQ ID NO: 206 or SEQ ID NO: 207 include the following:

In some embodiments, $X_2$ is Aib, $X_{10}$ is V, and $X_{14}$ is Y. In some embodiments, $X_2$ is Aib, $X_{10}$ is V, and $X_{19}$ is V. In some embodiments, $X_2$ is Aib, $X_{10}$ is V, and $X_{19}$ is A. In some embodiments, $X_2$ is Aib, $X_{10}$ is V, and $X_{20}$ is R. In some embodiments, $X_2$ is Aib, $X_{10}$ is V, and $X_{20}$ is K. In some embodiments, $X_2$ is Aib, $X_{10}$ is V, and $X_{21}$ is K. In some embodiments, $X_2$ is Aib, $X_{10}$ is V, and $X_{21}$ is Q. In some embodiments, $X_2$ is Aib, $X_{10}$ is V, and $X_{24}$ is S. In some embodiments, $X_2$ is Aib, $X_{10}$ is V, and $X_{24}$ is E.

In some embodiments, $X_2$ is Aib, $X_{14}$ is Y, and $X_{19}$ is V. In some embodiments, $X_2$ is Aib, $X_{14}$ is Y, and $X_{19}$ is A. In some embodiments, $X_2$ is Aib, $X_{14}$ is Y, and $X_{20}$ is R. In some embodiments, $X_2$ is Aib, $X_{14}$ is Y, and $X_{20}$ is K. In some embodiments, $X_2$ is Aib, $X_{14}$ is Y, and $X_{21}$ is K. In some embodiments, $X_2$ is Aib, $X_{14}$ is Y, and $X_{21}$ is Q. In some embodiments, $X_2$ is Aib, $X_{14}$ is Y, and $X_{24}$ is S. In some embodiments, $X_2$ is Aib, $X_{14}$ is Y, and $X_{24}$ is E.

In some embodiments, $X_{10}$ is V, $X_{14}$ is Y, and $X_{19}$ is V. In some embodiments, $X_{10}$ is V, $X_{14}$ is Y, and $X_{19}$ is A. In some embodiments, $X_{10}$ is V, $X_{14}$ is Y, and $X_{20}$ is R. In some embodiments, $X_{10}$ is V, $X_{14}$ is Y, and $X_{20}$ is K. In some embodiments, $X_{10}$ is V, $X_{14}$ is Y, and $X_{21}$ is K. In some embodiments, $X_{10}$ is V, $X_{14}$ is Y, and $X_{21}$ is Q. In some embodiments, $X_{10}$ is V, $X_{14}$ is Y, and $X_{24}$ is S. In some embodiments, $X_{10}$ is V, $X_{14}$ is Y, and $X_{24}$ is E.

In some embodiments, $X_{14}$ is Y, $X_{19}$ is V, and $X_{21}$ is K. In some embodiments, $X_{14}$ is Y, $X_{19}$ is A, and $X_{21}$ is K. In some embodiments, $X_{14}$ is Y, $X_{20}$ is R, and $X_{21}$ is K. In some embodiments, $X_{14}$ is Y, $X_{20}$ is K, and $X_{21}$ is K. In some embodiments, $X_{14}$ is Y, $X_{21}$ is K, and $X_{24}$ is S. In some embodiments, $X_{14}$ is Y, $X_{21}$ is K, and $X_{24}$ is E.

In some embodiments, $X_{19}$ is V, $X_{20}$ is R, and $X_{21}$ is K. In some embodiments, $X_{19}$ is V, $X_{20}$ is R, and $X_{21}$ is Q. In some embodiments, $X_{19}$ is V, $X_{20}$ is R, and $X_{24}$ is S. In some embodiments, $X_{19}$ is V, $X_{20}$ is R, and $X_{24}$ is E.

In some embodiments, $X_{19}$ is A, $X_{20}$ is R, and $X_{21}$ is K. In some embodiments, $X_{19}$ is A, $X_{20}$ is R, and $X_{21}$ is Q. In some embodiments, $X_{19}$ is A, $X_{20}$ is R, and $X_{24}$ is S. In some embodiments, $X_{19}$ is A, $X_{20}$ is R, and $X_{24}$ is E.

In some embodiments, $X_{20}$ is R, $X_{21}$ is K, and $X_{24}$ is S. In some embodiments, $X_{20}$ is R, $X_{21}$ is K, and $X_{24}$ is E.

In some embodiments, $X_{20}$ is K, $X_{21}$ is K, and $X_{24}$ is S. In some embodiments, $X_{20}$ is K, $X_{21}$ is K, and $X_{24}$ is E. In some embodiments, $X_{20}$ is K, $X_{21}$ is K, $X_{24}$ is E, and the peptide comprises a lactam bridge formed via an amide bond between the side chains of $X_{20}$ and $X_{24}$.

In certain embodiments, the present invention provides an isolated polypeptide, comprising the amino acid sequence of SEQ ID NO: 208: HAibEGTF-TSDX$_{10}$SKQYEX$_{16}$EAX$_{19}$X$_{20}$X$_{21}$FIX$_{24}$WLKNGGPS-SGAPPPS-(OH/NH$_2$) (SEQ ID NO: 208), or a pharmaceutically acceptable salt thereof, wherein:
$X_{10}$ is L or V;
$X_{16}$ is K covalently bound to a lipophilic substituent, optionally via a spacer;
$X_{19}$ is A or V;
$X_{20}$ is E, K, or R;
$X_{21}$ is K or Q;
$X_{24}$ is E, K, or S; and
wherein the peptide optionally further comprises a lactam bridge formed via an amide bond between the side chains of a lysine and a glutamic acid at positions $X_{21}$ and $X_{17}$, respectively; at positions $X_{20}$ and $X_{24}$, respectively; or at positions $X_{24}$ and $X_{20}$, respectively.

In some embodiments, if $X_{24}$ is S, then $X_{10}$ is V.

In some embodiments, the peptide comprises a lactam bridge formed via an amide bond between the side chains of a lysine and a glutamic acid at positions $X_{20}$ and $X_{24}$, respectively.

In some embodiments, $X_{10}$ is L. In some embodiments, $X_{10}$ is V.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is K. In some embodiments, $X_{21}$ is Q.

In some embodiments, $X_{24}$ is E. In some embodiments, $X_{24}$ is K. In some embodiments, $X_{24}$ is S.

In some embodiments, carboxy terminal amino acid, i.e. Sc, is —S$_{39}$—(NH$_2$). In some embodiments, carboxy terminal amino acid S$_{39}$ is —S$_{39}$—(OH).

In some embodiments, the isolated peptide further comprises a lactam bridge formed via an amide bond between the side chains of a lysine and a glutamic acid at positions $X_{21}$ and $X_{17}$, respectively. In some embodiments, the isolated peptide further comprises a lactam bridge formed via an amide bond between the side chains of a lysine and a glutamic acid at positions $X_{20}$ and $X_{24}$, respectively. In some embodiments, the isolated peptide further comprises a lactam bridge formed via an amide bond between the side chains of a lysine and a glutamic acid at positions $X_{24}$ and $X_{20}$, respectively.

In some embodiments, when K is selected at position $X_{20}$, $X_{21}$, or $X_{24}$, it represents lysine optionally covalently bound to a lipophilic substituent, optionally via a spacer.

In some embodiments, when K is selected at position $X_{20}$ or $X_{21}$, it represents lysine optionally covalently bound to a lipophilic substituent, optionally via a spacer.

In some embodiments, only the residue at $X_{16}$ is covalently bound to a lipophilic substituent, optionally via a spacer.

In some embodiments, certain amino acids represented by the consensus sequence of SEQ ID NO: 208 include the following:

In some embodiments, $X_{10}$ is V and $X_{19}$ is V. In some embodiments, $X_{10}$ is V and $X_{19}$ is A. In some embodiments, $X_{10}$ is V and $X_{20}$ is R. In some embodiments, $X_{10}$ is V and $X_{20}$ is K. In some embodiments, $X_{10}$ is V and $X_{21}$ is K. In some embodiments, $X_{10}$ is V and $X_{21}$ is Q. In some embodiments, $X_{10}$ is V and $X_{24}$ is S. In some embodiments, $X_{10}$ is V and $X_{24}$ is E.

In some embodiments, $X_{19}$ is V and $X_{20}$ is R. In some embodiments, $X_{19}$ is V and $X_{20}$ is K. In some embodiments, $X_{19}$ is V and $X_{21}$ is K. In some embodiments, $X_{19}$ is V and $X_{21}$ is Q. In some embodiments, $X_{19}$ is V and $X_{24}$ is S. In some embodiments, $X_{19}$ is V and $X_{24}$ is E.

In some embodiments, $X_{19}$ is A and $X_{20}$ is R. In some embodiments, $X_{19}$ is A and $X_{20}$ is K. In some embodiments, $X_{19}$ is A and $X_{21}$ is K. In some embodiments, $X_{19}$ is A and $X_{21}$ is Q. In some embodiments, $X_{19}$ is A and $X_{24}$ is S. In some embodiments, $X_{19}$ is A and $X_{24}$ is E.

In some embodiments, $X_{20}$ is R and $X_{21}$ is K. In some embodiments, $X_{20}$ is R and $X_{21}$ is Q. In some embodiments, $X_{20}$ is R and $X_{24}$ is S. In some embodiments, $X_{20}$ is R and $X_{24}$ is E.

In some embodiments, $X_{20}$ is K and $X_{21}$ is K. In some embodiments, $X_{20}$ is K and $X_{21}$ is Q. In some embodiments, $X_{20}$ is K and $X_{24}$ is S. In some embodiments, $X_{20}$ is K and $X_{24}$ is E. In some embodiments, $X_{20}$ is K, $X_{24}$ is E, and the peptide comprises a lactam bridge formed via an amide bond between the side chains of $X_{20}$ and $X_{24}$.

In some embodiments, $X_{21}$ is K and $X_{24}$ is S. In some embodiments, $X_{21}$ is K and $X_{24}$ is E.

In some embodiments, $X_{21}$ is Q and $X_{24}$ is S. In some embodiments, $X_{21}$ is Q and $X_{24}$ is E.

In some embodiments, certain amino acids represented by the consensus sequence of SEQ ID NO: 208 include the following:

In some embodiments, $X_{10}$ is V, $X_{19}$ is V, and $X_{20}$ is R. In some embodiments, $X_{10}$ is V, $X_{19}$ is V, and $X_{20}$ is K. In some embodiments, $X_{10}$ is V, $X_{19}$ is V, and $X_{21}$ is K. In some embodiments, $X_{10}$ is V, $X_{19}$ is V, and $X_{21}$ is Q. In some embodiments, $X_{10}$ is V, $X_{19}$ is V, and $X_{24}$ is S. In some embodiments, $X_{10}$ is V, $X_{19}$ is V, and $X_{24}$ is E.

In some embodiments, $X_{10}$ is V, $X_{19}$ is V, and $X_{24}$ is S. In some embodiments, $X_{10}$ is V, $X_{19}$ is A, and $X_{24}$ is S. In some embodiments, $X_{10}$ is V, $X_{20}$ is R, and $X_{24}$ is S. In some embodiments, $X_{10}$ is V, $X_{20}$ is K, and $X_{24}$ is S. In some embodiments, $X_{10}$ is V, $X_{21}$ is K, and $X_{24}$ is S. In some embodiments, $X_{10}$ is V, $X_{21}$ is Q, and $X_{24}$ is S.

In some embodiments, $X_{19}$ is V, $X_{20}$ is R, and $X_{21}$ is K. In some embodiments, $X_{19}$ is V, $X_{20}$ is R, and $X_{21}$ is Q. In some embodiments, $X_{19}$ is V, $X_{20}$ is R, and $X_{24}$ is S. In some embodiments, $X_{19}$ is V, $X_{20}$ is R, and $X_{24}$ is E.

In some embodiments, $X_{19}$ is A, $X_{20}$ is R, and $X_{21}$ is K. In some embodiments, $X_{19}$ is A, $X_{20}$ is R, and $X_{21}$ is Q. In some embodiments, $X_{19}$ is A, $X_{20}$ is R, and $X_{24}$ is S. In some embodiments, $X_{19}$ is A, $X_{20}$ is R, and $X_{24}$ is E.

In some embodiments, $X_{20}$ is R, $X_{21}$ is K, and $X_{24}$ is S. In some embodiments, $X_{20}$ is R, $X_{21}$ is K, and $X_{24}$ is E.

In some embodiments, $X_{20}$ is K, $X_{21}$ is K, and $X_{24}$ is S. In some embodiments, $X_{20}$ is K, $X_{21}$ is K, and $X_{24}$ is E. In some embodiments, $X_{20}$ is K, $X_{21}$ is K, $X_{24}$ is E, and the peptide comprises a lactam bridge formed via an amide bond between the side chains of $X_{20}$ and $X_{24}$.

Conjugation of a Lipophilic Substituent to any of the Peptides, Optionally Via a Spacer In some embodiments, any of the disclosed polypeptides is optionally substituted with one or more lipophilic substituents each optionally via a spacer, wherein "lipophilic substituent" and "spacer" are defined herein. In some embodiments, any of the disclosed polypeptides, comprising an amino acid sequence selected from the group consisting of amino acid sequences represented by any of the consensus sequences of SEQ ID NO:1 through SEQ ID NO:162 and SEQ ID NO: 1000 through SEQ ID NO: 1162, either comprises one or more lipophilic substituents each optionally via a spacer, or can be modified, or further modified, by covalent attachment of one or more lipophilic substituents each optionally via a spacer. In some embodiments, the lipophilic substituent may be attached to an amino group of the polypeptide (e.g., an ε-amino group of a lysine residue) by means of a carboxyl group of the lipophilic substituent, or optionally an amino group of the spacer, wherein a carboxyl group of the spacer forms an amide bond with an ε-amino group of a lysine residue.

Lipophilic Substituent

Conjugation of one or more "lipophilic substituents", each optionally via a "spacer," to any of the disclosed polypeptides of this invention is intended to prolong the action of the polypeptide by facilitating binding to serum albumin and delayed renal clearance of the conjugated polypeptide. As used herein, a "lipophilic substituent" comprises a substituent comprising 4 to 40 carbon atoms, 8 to 25 carbon atoms, 12 to 22 carbon atoms, or 6 to 20 carbon atoms. The lipophilic substituent may be attached to an amino group of the polypeptide (e.g., an ε-amino group of a lysine residue) by means of a carboxyl group of the lipophilic substituent, or optionally an amino group of the spacer, which carboxyl group of the spacer in turn forms an amide bond with an amino group of the amino acid (e.g., lysine) residue to which it is attached. In some embodiments, the polypeptide comprises three, two, or preferably one lipophilic substituent each with or without an optional spacer, which is defined in greater detail below.

In some embodiments, the lipophilic substituent comprises a straight-chain or branched alkyl group. In some embodiments, the lipophilic substituent is an acyl group of a straight-chain or branched fatty acid. In some embodiments, the lipophilic substituent is an acyl group of a straight-chain or branched fatty acid, further substituted with one or more carboxylic acid and/or hydroxamic acid groups.

In some embodiments, the polypeptide comprises three, two, or preferably one lipophilic substituents each without an optional spacer. In some embodiments, the lipophilic substituent is —CO(CH$_2$)$_{16}$CO$_2$H. In some embodiments, the lipophilic substituent is —CO(CH$_2$)$_{18}$CO$_2$H. In some embodiments, the lipophilic substituent is —CO(CH$_2$)$_{20}$CO$_2$H.

In some embodiments, the polypeptide comprises three, two, or preferably one lipophilic substituents each without an optional spacer. In some embodiments, the lipophilic substituent is a monovalent group of Formula I:

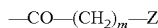   Formula I wherein
Z is —CH$_3$ or —CO$_2$H; and
m is from 4 to 24, which lipophilic substituent forms an amide bond between an amino group (e.g., ε-amino group of a lysine) of the disclosed polypeptide and a CO— group of the lipophilic substituent.

In some embodiments, Z is —CO$_2$H. In some embodiments, m is from 14 to 20. In some embodiments, the lipophilic substituent is covalently bound to the isolated polypeptide via a spacer. In some embodiments, the lipophilic substituent, —CO—(CH$_2$)$_m$—Z, is linked to an amino group of isolated polypeptide via the spacer, wherein the spacer forms a bridge between the amino group of the isolated polypeptide and a CO— group of the lipophilic substituent.

In some embodiments, m is selected from the group consisting of 4-20, 8-20, 12-20, 14-20, 16-20, 14, 16, 18, and 20.

In some embodiments, Z is —CO$_2$H, and the lipophilic substituent has the formula —CO—(CH$_2$)—CO$_2$H. In some embodiments, —CO—(CH$_2$)$_m$—Z is selected from the group consisting of —CO—(CH$_2$)$_4$—CO$_2$H, —CO—(CH$_2$)$_5$—CO$_2$H, —CO—(CH$_2$)$_6$—CO$_2$H, —CO—(CH$_2$)$_7$—CO$_2$H, —CO—(CH$_2$)$_8$—CO$_2$H, —CO—(CH$_2$)$_9$—CO$_2$H, —CO—(CH$_2$)$_{10}$—CO$_2$H, —CO—(CH$_2$)$_{11}$—CO$_2$H, —CO—(CH$_2$)$_{12}$—CO$_2$H, —CO—(CH$_2$)$_{13}$—CO$_2$H, —CO—(CH$_2$)$_{14}$—CO$_2$H, —CO—(CH$_2$)$_{15}$—CO$_2$H, —CO—(CH$_2$)$_{16}$—CO$_2$H, —CO—(CH$_2$)$_{17}$—CO$_2$H, —CO—(CH$_2$)$_{18}$—CO$_2$H, —CO—(CH$_2$)$_{19}$—CO$_2$H, —CO—(CH$_2$)$_{20}$—CO$_2$H.

In some embodiments, the lipophilic substituent is —CO—(CH$_2$)$_{14}$—CO$_2$H. In some embodiments, the lipophilic substituent is —CO—(CH$_2$)$_{16}$—CO$_2$H. In some embodiments, the lipophilic substituent is —CO—(CH$_2$)$_{18}$—CO$_2$H. In some embodiments, the lipophilic substituent is —CO—(CH$_2$)$_{20}$—CO$_2$H.

In some embodiments, Z is —CH$_3$, and the lipophilic substituent has the formula —CO—(CH$_2$)$_m$—CH$_3$. In some embodiments, —CO—(CH$_2$)$_m$—Z is selected from the group consisting of —CO—(CH$_2$)$_4$—CH$_3$, —CO—(CH$_2$)$_5$—CH$_3$, —CO—(CH$_2$)$_6$—CH$_3$, —CO—(CH$_2$)$_7$—CH$_3$, —CO—(CH$_2$)$_8$—CH$_3$, —CO—(CH$_2$)$_9$—CH$_3$, —CO—(CH$_2$)$_{10}$—CH$_3$, —CO—(CH$_2$)$_{11}$—CH$_3$, —CO—(CH$_2$)$_{12}$—CH$_3$, —CO—(CH$_2$)$_{13}$—CH$_3$, —CO—(CH$_2$)$_{14}$—CH$_3$, —CO—(CH$_2$)$_{15}$—CH$_3$, —CO—(CH$_2$)$_{16}$—CH$_3$, —CO—(CH$_2$)$_{17}$—CH$_3$, —CO—(CH$_2$)$_{18}$—CH$_3$, —CO—(CH$_2$)$_{19}$—CH$_3$, and —CO—(CH$_2$)$_{20}$—CH$_3$.

Lipophilic Substituent & Spacer

In some embodiments, the lipophilic substituent is attached to the parent peptide by means of a "spacer." In some embodiments, provided herein is any of the disclosed polypeptides, comprising an amino acid sequence selected from the group consisting of amino acid sequences represented by any of the consensus sequences of SEQ ID NO: 1 through SEQ ID NO: 143, comprising a lipophilic substituent, wherein the lipophilic substituent is linked to the ε-amino group of a lysine via a spacer, which spacer forms a bridge between an amino group of the disclosed polypeptide and a CO— group of the lipophilic substituent.

In some embodiments, the spacer comprises one or more amino acids, for example, single amino acid such as Glu, Asp, Gly or Lys, dipeptide such as 2(Glu), Glu-Gly, or polypeptide such as 3(Glu), 4(Glu) (SEQ ID NO: 9121), 2(Glu)-Gly etc. In some embodiments, when the spacer comprises one or more amino acids, e.g., Glu, Asp, Gly or Lys, one carboxyl group of the spacer may form an amide bond with an amino group of the disclosed polypeptide, and an amino group of the spacer may form an amide bond with a carboxyl group of the lipophilic substituent.

In some embodiments, when the spacer comprises Glu or Asp, that further include a carboxylic acid-terminating sidechain, the terminal carboxyl group of the sidechain of the Glu or Asp-containing spacer may form an amide bond with an amino group of the disclosed polypeptide, and an amino group of the Glu or Asp-containing spacer may form an amide bond with a carboxyl group of the lipophilic substituent, i.e., γGlu or βAsp.

In some embodiments, the spacer is -γGlu-γGlu-dpeg-. In some embodiments, the spacer is -γGlu-γGlu-dpeg-γGlu-γGlu-. In some embodiments, the spacer is —[COCH$_2$(OCH$_2$CH$_2$)$_2$NH]$_2$-γGlu-.

In some embodiments, the polypeptide comprises three, two, or preferably one lipophilic substituent each with a spacer. In some non-limiting embodiments, the lipophilic substituent and spacer form a monovalent group selected from the group consisting of those listed in Table 3:

TABLE 3

| representative lipophilic substituent and spacer moieties |
|---|
| -γGlu-γGlu-CO(CH$_2$)$_{16}$CO$_2$H |
| -γGlu-γGlu-CO(CH$_2$)$_{18}$CO$_2$H |
| -γGlu-γGlu-dpeg-CO(CH$_2$)$_{16}$CO$_2$H |
| -γGlu-γGlu-dpeg-CO(CH$_2$)$_{18}$CO$_2$H |
| -γGlu-γGlu-dpeg-γGlu-CO(CH$_2$)$_{16}$CO$_2$H |
| -γGlu-γGlu-dpeg-γGlu-CO(CH$_2$)$_{18}$CO$_2$H |
| -γGlu-γGlu-dpeg-γGlu-γGlu-CO(CH$_2$)$_{16}$CO$_2$H |
| -γGlu-γGlu-dpeg-γGlu-γGlu-CO(CH$_2$)$_{18}$CO$_2$H |
| -γGlu-γGlu-dpeg-dpeg-CO(CH$_2$)$_{16}$CO$_2$H |
| -γGlu-γGlu-dpeg-dpeg-CO(CH$_2$)$_{18}$CO$_2$H |
| -γGlu-γGlu-dpeg-dpeg-γGlu-CO(CH$_2$)$_{16}$CO$_2$H |
| -γGlu-γGlu-dpeg-dpeg-γGlu-CO(CH$_2$)$_{18}$CO$_2$H |
| -γGlu-γGlu-γGlu-CO(CH$_2$)$_{16}$CO$_2$H |
| -γGlu-γGlu-γGlu-CO(CH$_2$)$_{18}$CO$_2$H |
| -dpeg-dpeg-γGlu-CO(CH$_2$)$_{16}$CO$_2$H |
| -dpeg-dpeg-γGlu-CO(CH$_2$)$_{18}$CO$_2$H |
| -γGlu-γGlu-γGlu-dpeg-CO(CH$_2$)$_{16}$CO$_2$H |
| -γGlu-γGlu-γGlu-dpeg-CO(CH$_2$)$_{18}$CO$_2$H |
| -γGlu-dpeg-CO(CH$_2$)$_{16}$CO$_2$H |
| -γGlu-dpeg-CO(CH$_2$)$_{18}$CO$_2$H |
| -[COCH$_2$(OCH$_2$CH$_2$)$_2$NH]$_2$-γGlu-CO(CH$_2$)$_{16}$CO$_2$H |

In some embodiments, the lipophilic substituent and spacer form a monovalent group of Formula II:

—(Y)$_n$—CO—(CH$_2$)$_m$Z      Formula II wherein

Y is selected from the group consisting of γGlu, Asp, Lys and Gly;

Z is —CH$_3$ or —CO$_2$H;

m is from 4 to 24; and n is from 1 to 10.

In some embodiments, Z is —CO$_2$H. In some embodiments, m is from 14 to 20. In some embodiments, Y is γGlu. In some embodiments, n is from 1 to 5.

In some embodiments, Y is selected from the group consisting of γGlu and Gly. In some embodiments, Y is γGlu. In some embodiments, Y is Gly.

In some embodiments, the polypeptide comprises three, two, or preferably one lipophilic substituent each with a spacer. In some embodiments, the lipophilic substituent and spacer are a monovalent group of Formula III:

—(V)$_r$—(Y)$_n$—CO—(CH$_2$)$_m$Z      Formula III wherein,

V is —[COCH$_2$(OCH$_2$CH$_2$)$_t$NH]—;

Y is selected from the group consisting of γGlu, Asp, and Gly;

Z is —CH$_3$ or —CO$_2$H;

m is from 4 to 24;
n is from 1 to 10;
r is from 1 to 6; and
t is from 1 to 6.

In some embodiments, Z is —CO₂H. In some embodiments, Z is —CH₃.

In some embodiments, Y is γGlu. In some embodiments, Y is Asp. In some embodiments, Y is Gly.

In some embodiments, m is selected from the group consisting of 4-20, 8-20, 12-20, 14-20, 16-20, 14, 16, 18, and 20. In some embodiments, m is from 14 to 20.

In some embodiments, n is selected from the group consisting of 1, 2, 3, 4, 5, 6, 7, 8, 9 and 10. In some embodiments, n is from 1 to 5. In some embodiments, n is 1. In some embodiments, n is 2. In some embodiments, n is 3. In some embodiments, n is 4. In some embodiments, n is 5.

In some embodiments, r is from 1 to 3. In some embodiments, r is 1. In some embodiments, r is 2. In some embodiments, r is 3. In some embodiments, r is 4. In some embodiments, r is 5.

In some embodiments, t is from 1 to 3. In some embodiments, t is selected from the group consisting of 1, 2, 3, 4, 5 and 6.

In some embodiments, Y is γGlu; Z is —CO₂H; m is 16; n is 1; r is 2; and t is 2.

In an embodiment, —(V)ᵣ(Y)ₙ— is —[COCH₂(OCH₂CH₂)₂NH]₂-γGlu-. 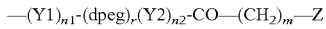

In some embodiments, the polypeptide comprises three, two, or preferably one lipophilic substituent each with a spacer. In some embodiments, the lipophilic substituent and spacer are a monovalent group of Formula IV:

—(Y1)ₙ₁-(dpeg)ᵣ(Y2)ₙ₂-CO—(CH₂)ₘ—Z     Formula IV wherein
Z is —CH₃ or —CO₂H;
m is from 4 to 24;
Y1 is selected from the group consisting of γGlu, Asp, and Gly;
Y2 is selected from the group consisting of γGlu, Asp, and Gly;
dpeg is —[CO(CH₂)O(CH₂)₂O(CH₂)NH]—;
r is from 1 to 8;
n1 is from 0 to 10; and
n2 is from 0 to 10.

In some embodiments, Z is —CO₂H. In some embodiments, Z is —CH₃.

In some embodiments, m is selected from the group consisting of 4-20, 8-20, 12-20, 14-20, 16-20, 14, 16, 18, and 20. In some embodiments, m is from 14 to 20.

In some embodiments, Y1 is γGlu. In some embodiments, Y1 is Asp. In some embodiments, Y1 is Gly.

In some embodiments, Y2 is γGlu. In some embodiments, Y2 is Asp. In some embodiments, Y2 is Gly.

In some embodiments, n1 is selected from the group consisting of 0, 1, 2, 3, 4, 5, 6, 7, 8, 9 and 10. In some embodiments, n1 is from 0 to 3. In some embodiments, n1 is 0. In some embodiments, n1 is 1. In some embodiments, n1 is 2. In some embodiments, n1 is 3. In some embodiments, n1 is 4. In some embodiments, n1 is 5.

In some embodiments, n2 is selected from the group consisting of 0, 1, 2, 3, 4, 5, 6, 7, 8, 9 and 10. In some embodiments, n2 is from 0 to 3. In some embodiments, n2 is 0. In some embodiments, n2 is 1. In some embodiments, n2 is 2. In some embodiments, n2 is 3. In some embodiments, n2 is 4. In some embodiments, n2 is 5.

In some embodiments, r is from 1 to 3. In some embodiments, r is 1. In some embodiments, r is 2. In some embodiments, r is 3. In some embodiments, r is 4. In some embodiments, r is 5. In some embodiments, r is 6. In some embodiments, r is 7. In some embodiments, r is 8.

In some embodiments, r is 1, n1 is 2, and n2 is 0.
In some embodiments, r is 1, n1 is 2, and n2 is 2.
In some embodiments, Y1 is γGlu and Y2 is γGlu.
In some embodiments, Y1 is γGlu and n2 is 0.
In some embodiments, Y1 is γGlu, r is 1, n1 is 2, and n2 is 0.

In some embodiments, —(Y1)ₙ₁-(dpeg)ᵣ-(Y2)ₙ₂- is selected from the group consisting of -γGlu-γGlu-dpeg-, -γGlu-γGlu-dpeg-γGlu-γGlu-, -γGlu-γGlu-dpeg-γGlu-, -γGlu-γGlu-dpeg-dpeg-, -γGlu-γGlu-dpeg-dpeg-γGlu-, -dpeg-dpeg-γGlu-, -γGlu-γGlu-γGlu-dpeg-, and -γGlu-dpeg-.

In some embodiments, the polypeptide comprises three, two, or preferably one lipophilic substituent each with a spacer. In some embodiments, the lipophilic substituent and spacer are a monovalent group of Formula V:

-(γGlu)ₙ-CO—(CH₂)ₘ—Z     Formula V 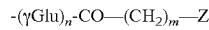

wherein
Z is —CH₃ or —CO₂H;
m is from 4 to 24; and
n is from 1 to 10 ("(γGlu)ₙ", where n is from 1 to 10 disclosed as SEQ ID NO: 9122).

In some embodiments, Z is —CH₃. In some embodiments, Z is —CO₂H.

In some embodiments, m is from 14 to 20.

In some embodiments, m is selected from the group consisting of 4-20, 8-20, 12-20, 14-20, 16-20, 14, 16, 18, and 20.

In some embodiments, n is selected from the group consisting of 1, 2, 3, 4, 5, 6, 7, 8, 9 and 10. In some embodiments, n is 1. In some embodiments, n is 2. In some embodiments, n is 3. In some embodiments, n is 4. In some embodiments, n is 5.

In some embodiments, the polypeptide comprises three, two, or preferably one lipophilic substituent each with a spacer. In some embodiments, the lipophilic substituent and spacer are a monovalent group of Formula VI:

-(γGlu)ₙ-(Gly)-CO—(CH₂)ₘ—Z     Formula VI 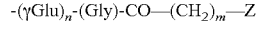

wherein
Z is —CH₃ or —CO₂H;
m is from 4 to 24; and
n is from 1 to 10 ("(γGlu)ₙ", where n is from 1 to 10 disclosed as SEQ ID NO: 9122).

In some embodiments, (γGlu)ₙ is selected from the group consisting of γGlu; 2(γGlu); 3(γGlu); 4(γGlu) (SEQ ID NO: 9123); and 5(γGlu) (SEQ ID NO: 9124). In some embodiments, -(γGlu)ₙ-(Gly)- is selected from the group consisting of 2(γGlu),Gly; and 3(γGlu),Gly (SEQ ID NO: 9125).

In some embodiments, the polypeptide comprises three, two, or preferably one lipophilic substituent each with a spacer. In some embodiments, the lipophilic substituent and spacer are a monovalent group of Formula VII:

-(Gly)-(γGlu)ₙ-(CO—(CH₂)ₘ—Z     Formula VII 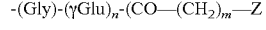

wherein
Z is —CH₃ or —CO₂H;
m is from 4 to 24; and
n is from 1 to 10 ("(Gly)-(γGlu)ₙ", where n is from 1 to 10 disclosed as SEQ ID NO: 9126).

In some embodiments, certain variables represented in certain of the preceding Formulae include the following:

In some embodiments, Z is —CH$_3$. In some embodiments, Z is —CO$_2$H.

In some embodiments, m is selected from the group consisting of 4-20, 8-20, 12-20, 14-20, 16-20, 14, 16, 18, and 20.

In some embodiments, n is selected from the group consisting of 1, 2, 3, 4, 5, 6, 7, 8, 9 and 10. In some embodiments, n is 1. In some embodiments, n is 2. In some embodiments, n is 3. In some embodiments, n is 4. In some embodiments, n is 5.

In some embodiments, n is 1 and Z is —CO$_2$H. In some embodiments, n is 1 and Z is —CH$_3$. In some embodiments, n is 2 and Z is —CO$_2$H. In some embodiments, n is 2 and Z is —CH$_3$. In some embodiments, n is 3 and Z is —CO$_2$H. In some embodiments, n is 3 and Z is —CH$_3$. In some embodiments, n is 4 and Z is —CO$_2$H. In some embodiments, n is 4 and Z is —CH$_3$. In some embodiments, n is 5 and Z is —CO$_2$H. In some embodiments, n is 5 and Z is —CH$_3$.

In some embodiments, n is 1, Z is —CO$_2$H, and m is 14-20. In some embodiments, n is 1, Z is —CO$_2$H, and m is 14. In some embodiments, n is 1, Z is —CO$_2$H, and m is 16. In some embodiments, n is 1, Z is —CO$_2$H, and m is 18.

In some embodiments, n is 1, Z is —CH$_3$, and m is 14-20. In some embodiments, n is 1, Z is —CH$_3$ and m is 14. In some embodiments, n is 1, Z is —CH$_3$, and m is 16. In some embodiments, n is 1, Z is —CH$_3$, and m is 18.

In some embodiments, n is 2, Z is —CO$_2$H, and m is 14-20. In some embodiments, n is 2, Z is —CO$_2$H, and m is 14. In some embodiments, n is 2, Z is —CO$_2$H, and m is 16. In some embodiments, n is 2, Z is —CO$_2$H, and m is 18.

In some embodiments, n is 2, Z is —CH$_3$, and m is 14-20. In some embodiments, n is 2, Z is —CH$_3$ and m is 14. In some embodiments, n is 2, Z is —CH$_3$, and m is 16. In some embodiments, n is 2, Z is —CH$_3$, and m is 18.

In some embodiments, n is 3, Z is —CO$_2$H, and m is 14-20. In some embodiments, n is 3, Z is —CO$_2$H, and m is 14. In some embodiments, n is 3, Z is —CO$_2$H, and m is 16. In some embodiments, n is 3, Z is —CO$_2$H, and m is 18.

In some embodiments, n is 3, Z is —CH$_3$, and m is 14-20. In some embodiments, n is 3, Z is —CH$_3$ and m is 14. In some embodiments, n is 3, Z is —CH$_3$, and m is 16. In some embodiments, n is 3, Z is —CH$_3$, and m is 18.

In some embodiments, n is 4, Z is —CO$_2$H, and m is 14-20. In some embodiments, n is 4, Z is —CO$_2$H, and m is 14. In some embodiments, n is 4, Z is —CO$_2$H, and m is 16. In some embodiments, n is 4, Z is —CO$_2$H, and m is 18.

In some embodiments, n is 4, Z is —CH$_3$, and m is 14-20. In some embodiments, n is 4, Z is —CH$_3$ and m is 14. In some embodiments, n is 4, Z is —CH$_3$, and m is 16. In some embodiments, n is 4, Z is —CH$_3$, and m is 18.

In some embodiments, n is 5, Z is —CO$_2$H, and m is 14-20. In some embodiments, n is 5, Z is —CO$_2$H, and m is 14. In some embodiments, n is 5, Z is —CO$_2$H, and m is 16. In some embodiments, n is 5, Z is —CO$_2$H, and m is 18.

In some embodiments, n is 5, Z is —CH$_3$, and m is 14-20. In some embodiments, n is 5, Z is —CH$_3$ and m is 14. In some embodiments, n is 5, Z is —CH$_3$, and m is 16. In some embodiments, n is 5, Z is —CH$_3$, and m is 18.

In some embodiments, the polypeptide comprises three, two, or preferably one lipophilic substituent each with a spacer. In some embodiments, the lipophilic substituent and spacer are a monovalent group of Formula VIII:

$$—(Y1)_{n1}\text{-}(V)_r\text{-}(Y2)_{n2}\text{-CO—}(CH_2)_m—Z \qquad \text{Formula VIII}$$

wherein
Z is —CH$_3$ or —CO$_2$H;
m is from 4 to 24;
Y1 is selected from the group consisting of γGlu, Asp, and Gly;
Y2 is selected from the group consisting of γGlu, Asp, and Gly;
V is —[COCH$_2$(OCH$_2$CH$_2$)$_t$NH]—;
r is from 1 to 6;
n1 is from 0 to 10;
n2 is from 0 to 10; and
t is from 1 to 6.

In some embodiments, the polypeptide comprises three, two, or preferably one lipophilic substituent each with a spacer. In some embodiments, the lipophilic substituent and spacer are a monovalent group of Formula IX:

$$—(Y)_n\text{-}(V)_r\text{CO—}(CH_2)_m—Z \qquad \text{Formula IX}$$

wherein
Z is —CH$_3$ or —CO$_2$H;
m is from 4 to 24;
Y is selected from the group consisting of γGlu, Asp, and Gly;
V is —[COCH$_2$(OCH$_2$CH$_2$)$_t$NH]—;
r is from 1 to 6; and
n is from 1 to 10; and
t is from 1 to 6.

In some embodiments, the polypeptide comprises three, two, or preferably one lipophilic substituent each with a spacer. In some embodiments, the lipophilic substituent and spacer are a monovalent group of Formula X:

$$\text{-(dpeg)}_r\text{-}(Y2)_{n2}\text{-CO—}(CH_2)_m Z \qquad \text{Formula X}$$

wherein
Z is —CH$_3$ or —CO$_2$H;
m is from 4 to 24;
dpeg is —[CO(CH$_2$)O(CH$_2$)$_2$O(CH$_2$)NH]—;
Y2 is selected from the group consisting of γGlu, Asp, and Gly;
r is from 1 to 8; and
n2 is from 0 to 10.

In some embodiments, -(dpeg)$_r$-(Y2)$_{n2}$- is selected from the group consisting of dpeg,γGlu; and dpeg,dpeg,γGlu.

In an embodiment, -(dpeg)$_r$-(Y2)$_{n2}$- is -dpeg-dpeg-γGlu-.

In some embodiments, the polypeptide comprises three, two, or preferably one lipophilic substituent each with a spacer. In some embodiments, the lipophilic substituent and spacer are a monovalent group of Formula XI:

$$—(Y1)_{n1}\text{-(dpeg)}_r\text{-CO—}(CH_2)_m—Z \qquad \text{Formula XI}$$

wherein
Z is —CH$_3$ or —CO$_2$H;
m is from 4 to 24;
Y1 is selected from the group consisting of γGlu, Asp, and Gly;
dpeg is —[CO(CH$_2$)O(CH$_2$)$_2$O(CH$_2$)NH]—;
r is from 1 to 8; and
n1 is from 0 to 10.

In some embodiments, Z is —CO$_2$H.

In some embodiments, m is selected from the group consisting of 4-20, 8-20, 12-20, 14-20, 16-20, 14, 16, 18, and 20. In some embodiments, m is from 14 to 20.

In some embodiments, Y1 is γGlu. In some embodiments, Y1 is Asp. In some embodiments, Y1 is Gly.

In some embodiments, n1 is selected from the group consisting of 0, 1, 2, 3, 4, 5, 6, 7, 8, 9 and 10. In some embodiments, n1 is from 0 to 3. In some embodiments, n1 is 0. In some embodiments, n1 is 1. In some embodiments, n1 is 2. In some embodiments, n1 is 3. In some embodiments, n1 is 4. In some embodiments, n1 is 5.

In some embodiments, r is from 1 to 3. In some embodiments, r is 1. In some embodiments, r is 2. In some embodiments, r is 3. In some embodiments, r is 4. In some embodiments, r is 5. In some embodiments, r is 6. In some embodiments, r is 7. In some embodiments, r is 8.

In some embodiments, r is 1 and n1 is 2.

In some embodiments, Y1 is γGlu, r is 1, and n1 is 2.

In some embodiments, —(Y1)$_{n1}$-(dpeg)$_r$ is selected from the group consisting of -γGlu-γGlu-dpeg-, -γGlu-γGlu-dpeg-dpeg-, -γGlu-γGlu-γGlu-dpeg-, and -γGlu-dpeg-.

Further Exemplary Spacers

In some embodiments, the spacer comprises a bivalent group of Formula XII:

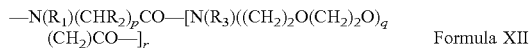  Formula XII wherein
each $R_1$ and $R_3$ is hydrogen or $C_1$-$C_4$ alkyl;
each $R_2$ is H or $CO_2H$;
p is 1, 2, 3, 4, 5 or 6;
q is 1, 2 or 3;
r is 0 or 1.
which spacer forms a bridge between an amino group of the disclosed polypeptide and a CO— group of the lipophilic substituent.

In some embodiments, the spacer comprises a bivalent group of Formula XIII:

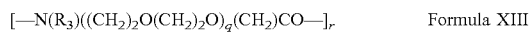  Formula XIII wherein
each $R_3$ is hydrogen or $C_1$-$C_4$ alkyl;
q is 1, 2 or 3;
r is 0 or 1.
which spacer forms a bridge between an amino group of the disclosed polypeptide and a CO— group of the lipophilic substituent.

In some embodiments, certain variables represented in certain Formulae include the following:

In some embodiments, each $R_1$ is hydrogen. In some embodiments, each $R_3$ is hydrogen. In some embodiments, each $R_1$ and each $R_3$ are hydrogen.

In some embodiments, at least one $R_2$ is $CO_2H$. In some embodiments, one $R_2$ is $CO_2H$.

In some embodiments, p is 1. In some embodiments, p is 2. In some embodiments, p is 3. In some embodiments, p is 4. In some embodiments, p is 5. In some embodiments, p is 6.

In some embodiments, q is 1. In some embodiments, q is 2. In some embodiments, q is 3.

In some embodiments, r is 0. In some embodiments, r is 1.

In some embodiments, the spacer is γ-glutamyl, i.e., —NH(CHCO$_2$H)(CH$_2$)$_2$CO—. In some embodiments, the spacer is γ-aminobutanoyl, i.e., —NH(CH$_2$)$_3$CO—. In some embodiments, the spacer is β-asparagyl, i.e., —NH(CHCO$_2$H)(CH$_2$)CO—. In some embodiments, the spacer is —NH(CH$_2$)$_2$CO—. In some embodiments, the spacer is glycyl. In some embodiments, the spacer is β-alanyl.

In some embodiments, the spacer is —NHCH(CO$_2$H)(CH$_2$)$_2$CO—[N(R$_3$)((CH$_2$)$_2$O(CH$_2$)$_2$O)$_q$(CH$_2$)CO]r. In some embodiments, the spacer is —NH(CH$_2$)$_3$CO—[N(R$_3$)((CH$_2$)$_2$O(CH$_2$)$_2$O)$_q$(CH$_2$)CO]r. In some embodiments, the spacer is —NHCH(CO$_2$H)(CH$_2$)$_2$CO—NH((CH$_2$)$_{20}$(CH$_2$)$_{20}$)$_2$(CH$_2$)CO—. In some embodiments, the spacer is —NH(CH$_2$)$_3$CO—NH((CH$_2$)$_{20}$(CH$_2$)$_{20}$)$_2$(CH$_2$)CO—. In some embodiments, the spacer is —NHCH(CO$_2$H)CH$_2$CO—[N(R$_3$)((CH$_2$)$_2$O(CH$_2$)$_2$O)$_q$(CH$_2$)CO—]$_r$. In some embodiments, the spacer is —NH(CH$_2$)$_2$CO—[N(R$_3$)((CH$_2$)$_2$O(CH$_2$)$_2$O)$_q$(CH$_2$)CO—]$_r$.

In some embodiments, the spacer comprises a bivalent group of Formula XIV:

—(Y)$_n$—  Formula XIV wherein
Y is selected from the group consisting of γGlu, Asp, Lys and Gly;
n is from 1 to 10.

In some embodiments, Y is selected from the group consisting of γGlu and Gly. In some embodiments, Y is γGlu. In some embodiments, Y is Gly.

In some embodiments, the spacer forms a bridge between an amino group of the disclosed polypeptide and a CO— group of a lipophilic substituent. In some embodiments, one end of the spacer forms a covalent bond with an amino group of the disclosed polypeptide and the other end of the spacer forms a covalent bond with a hydrogen atom or a protecting group.

In some embodiments, the spacer comprises a bivalent group of Formula XV:

-(γGlu)$_n$-  Formula XV wherein
n is from 1 to 10 ("(γGlu)$_n$", where n is from 1 to 10 disclosed as SEQ ID NO: 9122).

In some embodiments, n is selected from the group consisting of 1, 2, 3, 4, 5, 6, 7, 8, 9 and 10. In some embodiments, n is 1. In some embodiments, n is 2. In some embodiments, n is 3. In some embodiments, n is 4. In some embodiments, n is 5.

In some embodiments, the spacer forms a bridge between an amino group of the disclosed polypeptide and a CO— group of a lipophilic substituent. In some embodiments, one end of the spacer forms a covalent bond with an amino group of the disclosed polypeptide and the other end of the spacer forms a covalent bond with a hydrogen atom or a protecting group.

In some embodiments, the spacer comprises a bivalent group of Formula XVI:

-(γGlu)$_n$-(Gly)-  Formula XVI wherein
n is from 1 to 10 ("(γGlu)$_n$-(Gly)", where n is from 1 to 10 disclosed as SEQ ID NO: 9127).

In some embodiments, (γGlu)$_n$ is selected from the group consisting of γGlu; 2(γGlu); 3(γGlu); 4(γGlu) (SEQ ID NO: 9123); and 5(γGlu) (SEQ ID NO: 9124). In some embodiments, -(γGlu)$_n$-(Gly)- is selected from the group consisting of 2(γGlu),Gly; and 3(γGlu),Gly (SEQ ID NO: 9125).

In some embodiments, the spacer forms a bridge between an amino group of the disclosed polypeptide and a CO— group of a lipophilic substituent. In some embodiments, one end of the spacer forms a covalent bond with an amino group of the disclosed polypeptide and the other end of the spacer forms a covalent bond with a hydrogen atom or a protecting group.

In some embodiments, the spacer comprises a bivalent group of Formula XVII:

-(Gly)-(γGlu)$_n$-  Formula XVII wherein
n is from 1 to 10 ("(Gly)-(γGlu)$_n$", where n is from 1 to 10 disclosed as SEQ ID NO: 9126).

In some embodiments, the spacer forms a bridge between an amino group of the disclosed polypeptide and a CO— group of a lipophilic substituent. In some embodiments, one end of the spacer forms a covalent bond with an amino group of the disclosed polypeptide and the other end of the spacer forms a covalent bond with a hydrogen atom or a protecting group.

In some embodiments, n is selected from the group consisting of 1, 2, 3, 4, 5, 6, 7, 8, 9 and 10. In some embodiments, n is 1. In some embodiments, n is 2. In some embodiments, n is 3. In some embodiments, n is 4. In some embodiments, n is 5.

In some embodiments, the spacer comprises a bivalent group of Formula XVIII: Formula XVIII:

    Formula XVII wherein
Y is selected from the group consisting of γGlu, Asp, and Gly;
V is —[COCH$_2$(OCH$_2$CH$_2$)$_t$NH]—;
r is from 1 to 6;
n is from 1 to 10; and
t is from 1 to 6.

In some embodiments, Y is γGlu. In some embodiments, Y is Asp. In some embodiments, Y is Gly.

In some embodiments, n is selected from the group consisting of 1, 2, 3, 4, 5, 6, 7, 8, 9 and 10. In some embodiments, n is from 1 to 5. In some embodiments, n is 1. In some embodiments, n is 2. In some embodiments, n is 3. In some embodiments, n is 4. In some embodiments, n is 5.

In some embodiments, r is from 1 to 3. In some embodiments, r is 1. In some embodiments, r is 2. In some embodiments, r is 3. In some embodiments, r is 4. In some embodiments, r is 5.

In some embodiments, t is from 1 to 3. In some embodiments, t is selected from the group consisting of 1, 2, 3, 4, 5 and 6.

In an embodiment, —(V)$_r$—(Y)$_n$— is —[COCH$_2$(OCH$_2$CH$_2$)$_2$NH]$_2$-γGlu-.

In some embodiments, the spacer forms a bridge between an amino group of the disclosed polypeptide and a CO— group of a lipophilic substituent. In some embodiments, one end of the spacer forms a covalent bond with an amino group of the disclosed polypeptide and the other end of the spacer forms a covalent bond with a hydrogen atom or a protecting group.

In some embodiments, the spacer comprises a bivalent group of Formula XIX:

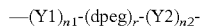    Formula XIX wherein
Y1 is selected from the group consisting of γGlu, Asp, and Gly;
Y2 is selected from the group consisting of γGlu, Asp, and Gly;
dpeg is —[CO(CH$_2$)O(CH$_2$)$_2$O(CH$_2$)NH]—;
r is from 1 to 8;
n1 is from 0 to 10; and
n2 is from 0 to 10.

In some embodiments, Y1 is γGlu. In some embodiments, Y1 is Asp. In some embodiments, Y1 is Gly.
In some embodiments, Y2 is γGlu. In some embodiments, Y2 is Asp. In some embodiments, Y2 is Gly.

In some embodiments, n1 is selected from the group consisting of 0, 1, 2, 3, 4, 5, 6, 7, 8, 9 and 10. In some embodiments, n1 is from 0 to 3. In some embodiments, n1 is 0. In some embodiments, n1 is 1. In some embodiments, n1 is 2. In some embodiments, n1 is 3. In some embodiments, n1 is 4. In some embodiments, n1 is 5.

In some embodiments, n2 is selected from the group consisting of 0, 1, 2, 3, 4, 5, 6, 7, 8, 9 and 10. In some embodiments, n2 is from 0 to 3. In some embodiments, n2 is 0. In some embodiments, n2 is 1. In some embodiments, n2 is 2. In some embodiments, n2 is 3. In some embodiments, n2 is 4. In some embodiments, n2 is 5.

In some embodiments, r is from 1 to 3. In some embodiments, r is 1. In some embodiments, r is 2. In some embodiments, r is 3. In some embodiments, r is 4. In some embodiments, r is 5. In some embodiments, r is 6. In some embodiments, r is 7. In some embodiments, r is 8.

In some embodiments, r is 1, n1 is 2, and n2 is 0.
In some embodiments, r is 1, n1 is 2, and n2 is 2.
In some embodiments, Y1 is γGlu and Y2 is γGlu.
In some embodiments, Y1 is γGlu and n2 is 0.
In some embodiments, Y1 is γGlu, r is 1, n1 is 2, and n2 is 0.

In some embodiments, —(Y1)$_{n1}$-(dpeg)$_r$-(Y2)$_{n2}$- is selected from the group consisting of -γGlu-γGlu-dpeg-, -γGlu-γGlu-dpeg-γGlu-γGlu-, -γGlu-γGlu-dpeg-γGlu-, -γGlu-γGlu-dpeg-dpeg-, -γGlu-γGlu-dpeg-dpeg-γGlu-, -dpeg-dpeg-γGlu-, -γGlu-γGlu-γGlu-dpeg-, and -γGlu-dpeg-.

In some embodiments, the spacer forms a bridge between an amino group of the disclosed polypeptide and a CO— group of a lipophilic substituent. In some embodiments, one end of the spacer forms a covalent bond with an amino group of the disclosed polypeptide and the other end of the spacer forms a covalent bond with a hydrogen atom or a protecting group.

Accordingly, in some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent, and optionally comprises a spacer.

In some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent of Formula I.

In some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent of Formula I and a spacer selected from the group consisting of those described by Formula XII, XIII, XIV, XV, XVI, XVII, XVIII, and XIX.

In some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent and a spacer selected from the group consisting of those described by Formula I, II, III, IV, V, VI, VII, VIII, IX, X, and XI.

In some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent and a spacer selected from the group consisting of those described by Formula I.

In some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent and a spacer selected from the group consisting of those described by Formula II.

In some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent and a spacer selected from the group consisting of those described by Formula III.

In some embodiments, an isolated polypeptide provided herein comprises an amino acid sequence, or a pharmaceutically acceptable salt thereof, selected from the group consisting of amino acid sequences represented by a consensus sequence selected from the group consisting of SEQ ID NO: 1000 to SEQ ID NO: 1162, wherein the isolated peptide further comprises a lipophilic substituent and a spacer selected from the group consisting of those described by Formula IV.

As used herein, (γGlu)$_2$ and 2(γGlu) both mean -(γGlu)-(γGlu)- or —CO(CH$_2$)$_2$CH(CO$_2$H)NH—CO(CH$_2$)$_2$CH(CO$_2$H)NH—; (γGlu)$_3$ and 3(γGlu) both mean -(γGlu)-(γGlu)-(γGlu)- or —CO(CH$_2$)$_2$CH(CO$_2$H)NH—CO(CH$_2$)$_2$CH(CO$_2$H)NH—CO(CH$_2$)$_2$CH(CO$_2$H)NH—; etc.; where a variable is present more than once in a given formula, each occurrence of that variable is independently determined. For example, for group —(Y)$_3$—, where Y may be γGlu, Asp, Lys, or Gly, each Y is independently selected to be one of the four amino acids. Accordingly, by non-limiting example, —(Y)$_3$— may be -(γGlu)-(γGlu)-(γGlu)-, -(γGlu)-(Asp)-(γGlu)-, -(Gly)-(Asp)-(γGlu)-, or -(Gly)-(γGlu)-(γGlu)-.

Bridging Moiety

In Some Embodiments, any of the Disclosed Polypeptides is Optionally Substituted with One or more bridging moieties. As used herein, the term "bridging moiety" means a covalent bond or any bivalent linker or moiety that joins two sidechains of two separate amino acid residues. In some embodiments, any of the disclosed polypeptides is optionally substituted with one or more lactam bridging moieties. As used herein, the term "lactam bridging moiety" means a lactam bridge or lactam bond that joins amino-containing and carboxy-containing sidechains of two separate amino acid residues.

Exemplary Compounds: GLP-1 Receptor Agonist Polypeptides

In some embodiments, an isolated polypeptide of the disclosure comprises an amino acid sequence selected from the group consisting of the following peptides listed in Table 4:

TABLE 4

Exemplary compounds: GLP-1 receptor agonist polypeptides covalently bound to a lipophilic substituent, optionally via a spacer

| Compound No. | Sequence | SEQ ID NO: |
|---|---|---|
| A1 | HGEGTFTSDLSKQK*(dpeg-dpeg-γGlu-CO(CH$_2$)$_{16}$CO$_2$H)EEEAVRLFIEWLKNGGPSSGAPPPS-(NH$_2$) | SEQ ID NO: 1 |
| A2 | HGEGTFTSDLSKQMEEK*(dpeg-dpeg-γGlu-CO(CH$_2$)$_{16}$CO$_2$H)AVRLFIEWLKNGGPSSGAPPPS-(NH$_2$) | SEQ ID NO: 2 |
| A3 | HGEGTFTSDLSKQMEEEK*(dpeg-dpeg-γGlu-CO(CH$_2$)$_{16}$CO$_2$H)VRLFIEWLKNGGPSSGAPPPS-(NH$_2$) | SEQ ID NO: 3 |
| A4 | HGEGTFTSDLSKQMEEEAVK*(dpeg-dpeg-γGlu-CO(CH$_2$)$_{16}$CO$_2$H)LFIEWLKNGGPSSGAPPPS-(NH$_2$) | SEQ ID NO: 4 |
| A5 | HGEGTFTSDLSKQMEEEAVRK*(dpeg-dpeg-γGlu-CO(CH$_2$)$_{16}$CO$_2$H)FIEWLKNGGPSSGAPPPS-(NH$_2$) | SEQ ID NO: 5 |
| A6 | HGEGTFTSDLSKQMEK*(dpeg-dpeg-γGlu-CO(CH$_2$)$_{16}$CO$_2$H)EAVRLFIEWLKNGGPSSGAPPPS-(NH$_2$) | SEQ ID NO: 6 |
| A7 | HGEGTFTSDLSKQMEK*(γGlu-γGlu-CO(CH$_2$)$_{18}$CO$_2$H)EAVRLFIEWLKNGGPSSGAPPPS-(NH$_2$) | SEQ ID NO: 7 |
| A8 | HGEGTFTSDLSKQMEK*(γGlu-γGlu-CO(CH$_2$)$_{16}$CO$_2$H)EAVRLFIEWLKNGGPSSGAPPPS-(NH$_2$) | SEQ ID NO: 8 |
| A9 | HGEGTFTSDLSKQMEK*(γGlu-γGlu-dpeg-CO(CH$_2$)$_{18}$CO$_2$H)EAVRLFIEWLKNGGPSSGAPPPS-(NH$_2$) | SEQ ID NO: 9 |

TABLE 4-continued

Exemplary compounds: GLP-1 receptor agonist polypeptides covalently bound to a lipophilic substituent, optionally via a spacer

| Compound No. | Sequence | SEQ ID NO: |
|---|---|---|
| A10 | HGEGTFTSDLSKQMEK*(γGlu-γGlu-dpeg-CO(CH$_2$)$_{16}$CO$_2$H)EAVRLFIEWLKNGGPSSGAPPPS-(NH$_2$) | SEQ ID NO: 10 |
| A11 | HGEGTFTSDLSKQMEK*(dpeg-dpeg-γGlu-CO(CH$_2$)$_{18}$CO$_2$H)EAVRLFIEWLKNGGPSSGAPPPS-(NH$_2$) | SEQ ID NO: 11 |
| A12 | HGEGTFTSDLSKQMEk*(dpeg-dpeg-γGlu-CO(CH$_2$)$_{18}$CO$_2$H)EAVRLFIEWLKNGGPSSGAPPPS-(NH$_2$) | SEQ ID NO: 12 |
| A13 | HGEGTFTSDLSKQLEK*(γGlu-γGlu-CO(CH$_2$)$_{18}$CO$_2$H)EAVRLFIEWLKNGGPSSGAPPPS-(NH$_2$) | SEQ ID NO: 13 |
| A14 | HGEGTFTSDLSKQFEK*(γGlu-γGlu-CO(CH$_2$)$_{18}$CO$_2$H)EAVRLFIEWLKNGGPSSGAPPPS-(NH$_2$) | SEQ ID NO: 14 |
| A15 | HGEGTFTSDLSKQYEK*(γGlu-γGlu-CO(CH$_2$)$_{18}$CO$_2$H)EAVRLFIEWLKNGGPSSGAPPPS-(NH$_2$) | SEQ ID NO: 15 |
| A16 | HGEGTFTSDLSKQQEK*(γGlu-γGlu-CO(CH$_2$)$_{18}$CO$_2$H)EAVRLFIEWLKNGGPSSGAPPPS-(NH$_2$) | SEQ ID NO: 16 |
| A17 | HGEGTFTSDLSKYMEK*(γGlu-γGlu-CO(CH$_2$)$_{18}$CO$_2$H)EAVRLFIEWLKNGGPSSGAPPPS-(NH$_2$) | SEQ ID NO: 17 |
| A18 | HGEGTFTSDLSKEMEK*(γGlu-γGlu-CO(CH$_2$)$_{18}$CO$_2$H)EAVRLFIEWLKNGGPSSGAPPPS-(NH$_2$) | SEQ ID NO: 18 |
| A19 | HGEGTFTSDLSKKMEK*(γGlu-γGlu-CO(CH$_2$)$_{18}$CO$_2$H)EAVRLFIEWLKNGGPSSGAPPPS-(NH$_2$) | SEQ ID NO: 19 |
| A20 | HGEGTFTSDLSKSMEK*(γGlu-γGlu-CO(CH$_2$)$_{18}$CO$_2$H)EAVRLFIEWLKNGGPSSGAPPPS-(NH$_2$) | SEQ ID NO: 20 |
| A21 | HAEGTFTSDLSKQMEK*(γGlu-γGlu-dpeg-CO(CH$_2$)$_{18}$CO$_2$H)EAVRLFIEWLKNGGPSSGAPPPS-(NH$_2$) | SEQ ID NO: 21 |
| A22 | H(Aib)EGTFTSDLSKQMEK*(γGlu-γGlu-dpeg-CO(CH$_2$)$_{18}$CO$_2$H)EAVRLFIEWLKNGGPSSGAPPPS-(NH$_2$) | SEQ ID NO: 22 |
| A23 | HA(n-methyl-E)GTFTSDLSKQMEK*(γGlu-γGlu-dpeg-CO(CH$_2$)$_{18}$CO$_2$H)EAVRLFIEWLKNGGPSSGAPPPS-(NH$_2$) | SEQ ID NO: 23 |
| A24 | HGEGTFTSDLSKQMEK*(γGlu-γGlu-dpeg-γGlu-CO(CH$_2$)$_{16}$CO$_2$H)EAVRLFIEWLKNGGPSSGAPPPS-(NH$_2$) | SEQ ID NO: 24 |
| A25 | HGEGTFTSDLSKQMEK*(γGlu-γGlu-γGlu-dpeg-CO(CH$_2$)$_{16}$CO$_2$H)EAVRLFIEWLKNGGPSSGAPPPS-(NH$_2$) | SEQ ID NO: 25 |
| A26 | HGEGTFTSDLSKQMEK*(γGlu-γGlu-dpeg-dpeg-CO(CH$_2$)$_{16}$CO$_2$H)EAVRLFIEWLKNGGPSSGAPPPS-(NH$_2$) | SEQ ID NO: 26 |
| A27 | HGEGTFTSDLSKQYEK*(γGlu-γGlu-dpeg-CO(CH$_2$)$_{18}$CO$_2$H)EAVRLFIAWLKNGGPSSGAPPPS-(NH$_2$) | SEQ ID NO: 27 |
| A28 | HGEGTFTSDLSKQYEK*(γGlu-γGlu-dpeg-CO(CH$_2$)$_{18}$CO$_2$H)EAVRLFISWLKNGGPSSGAPPPS-(NH$_2$) | SEQ ID NO: 28 |
| A29 | HGEGTFTSDLSKQYEK*(γGlu-γGlu-dpeg-CO(CH$_2$)$_{18}$CO$_2$H)EAVRLFIKWLKNGGPSSGAPPPS-(NH$_2$) | SEQ ID NO: 29 |
| A30 | HGEGTFTSDLSKQYEK*(γGlu-γGlu-dpeg-CO(CH$_2$)$_{18}$CO$_2$H)EAVRLFIQWLKNGGPSSGAPPPS-(NH$_2$) | SEQ ID NO: 30 |
| A31 | HGEGTFTSDLSKQYEK*(γGlu-γGlu-dpeg-CO(CH$_2$)$_{18}$CO$_2$H)EAVRLFIYWLKNGGPSSGAPPPS-(NH$_2$) | SEQ ID NO: 31 |
| A32 | HGEGTFTSDLSKQYEK*(γGlu-γGlu-dpeg-CO(CH$_2$)$_{18}$CO$_2$H)EAVRLFI(Aib)WLKNGGPSSGAPPPS-(NH$_2$) | SEQ ID NO: 32 |
| A33 | HGEGTFTSDLSKQMEK*(γGlu-γGlu-dpeg-γGlu-CO(CH$_2$)$_{18}$CO$_2$H)EAVRLFIEWLKNGGPSSGAPPPS-(NH$_2$) | SEQ ID NO: 33 |
| A34 | HGEGTFTSDLSKQMEK*(γGlu-γGlu-dpeg-dpeg-γGlu-CO(CH$_2$)$_{16}$CO$_2$H)EAVRLFIEWLKNGGPSSGAPPPS-(NH$_2$) | SEQ ID NO: 34 |

TABLE 4-continued

Exemplary compounds: GLP-1 receptor agonist polypeptides covalently bound to a lipophilic substituent, optionally via a spacer

| Compound No. | Sequence | SEQ ID NO: |
|---|---|---|
| A35 | HGEGTFTSDLSKQMEK*(γGlu-γGlu-dpeg-dpeg-γGlu-CO(CH$_2$)$_{18}$CO$_2$H)EAVRLFIEWLKNGGPSSGAPPPS-(NH$_2$) | SEQ ID NO: 35 |
| A36 | HGEGTFTSDLSKQMEK*(γGlu-γGlu-dpeg-γGlu-γGlu-CO(CH$_2$)$_{16}$CO$_2$H)EAVRLFIEWLKNGGPSSGAPPPS-(NH$_2$) | SEQ ID NO: 36 |
| A37 | HGEGTFTSDLSKQMEK*(γGlu-γGlu-dpeg-γGlu-γGlu-CO(CH$_2$)$_{18}$CO$_2$H)EAVRLFIEWLKNGGPSSGAPPPS-(NH$_2$) | SEQ ID NO: 37 |
| A38 | HGEGTFTSDLSKQMEK*(γGlu-γGlu-dpeg-dpeg-CO(CH$_2$)$_{18}$CO$_2$H)EAVRLFIEWLKNGGPSSGAPPPS-(NH$_2$) | SEQ ID NO: 38 |
| A39 | HGEGTFTSDLSKQYEK*(γGlu-γGlu-dpeg-CO(CH$_2$)$_{18}$CO$_2$H)EAVREFIEWLKNGGPSSGAPPPS-(NH$_2$) | SEQ ID NO: 39 |
| A40 | HGEGTFTSDLSKQYEK*(γGlu-γGlu-dpeg-CO(CH$_2$)$_{18}$CO$_2$H)EAVRYFIEWLKNGGPSSGAPPPS-(NH$_2$) | SEQ ID NO: 40 |
| A41 | HGEGTFTSDLSKQYEK*(γGlu-γGlu-dpeg-CO(CH$_2$)$_{18}$CO$_2$H)EAVRQFIEWLKNGGPSSGAPPPS-(NH$_2$) | SEQ ID NO: 41 |
| A42 | HGEGTFTSDLSKQYEK*(γGlu-γGlu-dpeg-CO(CH$_2$)$_{18}$CO$_2$H)EAVRKFIEWLKNGGPSSGAPPPS-(NH$_2$) | SEQ ID NO: 42 |
| A43 | HGEGTFTSDLSKQYEK*(γGlu-γGlu-dpeg-CO(CH$_2$)$_{18}$CO$_2$H)EAVR(Aib)FIEWLKNGGPSSGAPPPS-(NH$_2$) | SEQ ID NO: 43 |
| A44 | HGEGTFTSDLSKQYEK*(γGlu-γGlu-dpeg-CO(CH$_2$)$_{18}$CO$_2$H)EAVRHFIEWLKNGGPSSGAPPPS-(NH$_2$) | SEQ ID NO: 44 |
| A45 | H(Aib)EGTFTSDLSKQYEK*(γGlu-γGlu-dpeg-CO(CH$_2$)$_{18}$CO$_2$H)EAVRLFISWLKNGGPSSGAPPPS-(NH$_2$) | SEQ ID NO: 45 |
| A46 | H(Aib)EGTFTSDLSKQYEK*(γGlu-γGlu-dpeg-CO(CH$_2$)$_{18}$CO$_2$H)EAVRLFIEWLKNGGPSSGAPPPS-(NH$_2$) | SEQ ID NO: 46 |
| A47 | HGEGTFTSELSKQYEK*(γGlu-γGlu-dpeg-CO(CH$_2$)$_{18}$CO$_2$H)EAVRLFIEWLKNGGPSSGAPPPS-(NH$_2$) | SEQ ID NO: 47 |
| A48 | HGEGTFTSDLSKQYEK*(γGlu-γGlu-dpeg-CO(CH$_2$)$_{18}$CO$_2$H)EAAKLFISWLKNGGPSSGAPPPS-(NH$_2$) | SEQ ID NO: 48 |
| A49 | HGEGTFTSDLSKQYEK*(γGlu-γGlu-dpeg-CO(CH$_2$)$_{18}$CO$_2$H)EAARLFISWLKNGGPSSGAPPPS-(NH$_2$) | SEQ ID NO: 49 |
| A50 | HGEGTFTSDLSKQYEK*(γGlu-γGlu-dpeg-CO(CH$_2$)$_{18}$CO$_2$H)EAVRLFISWLKNGGPDapSGAPPPS-(NH$_2$) | SEQ ID NO: 50 |
| A51 | HGEGTFTSDLSKQYEK*(γGlu-γGlu-dpeg-CO(CH$_2$)$_{18}$CO$_2$H)EAVRLFISWLKNGGPKSGAPPPS-(NH$_2$) | SEQ ID NO: 51 |
| A52 | HGEGTFTSDLSKQYEK*(γGlu-γGlu-dpeg-CO(CH$_2$)$_{18}$CO$_2$H)EAVRLFISWLKNGGPHSGAPPPS-(NH$_2$) | SEQ ID NO: 52 |
| A53 | HGEGTFTSDLSKQYEK*(γGlu-γGlu-dpeg-CO(CH$_2$)$_{18}$CO$_2$H)EAVRLFISWLKNGGPRSGAPPPS-(NH$_2$) | SEQ ID NO: 53 |
| A54 | H(Aib)EGTFTSDLSKQYEK*(γGlu-γGlu-dpeg-CO(CH$_2$)$_{18}$CO$_2$H)EAVREFIEWLKNGGPSSGAPPPS-(NH$_2$) | SEQ ID NO: 54 |
| A55 | H(Aib)EGTFTSDLSKQYEK*(γGlu-γGlu-dpeg-CO(CH$_2$)$_{18}$CO$_2$H)EAVRQFIEWLKNGGPSSGAPPPS-(NH$_2$) | SEQ ID NO: 55 |
| A56 | H(Aib)EGTFTSDLSKQYEK*(γGlu-γGlu-dpeg-CO(CH$_2$)$_{18}$CO$_2$H)EAARLFIEWLKNGGPSSGAPPPS-(NH$_2$) | SEQ ID NO: 56 |
| A57 | H(Aib)EGTFTSDLSKQYEK*(γGlu-γGlu-dpeg-CO(CH$_2$)$_{18}$CO$_2$H)EAARLFIEWLKNGGPHSGAPPPS-(NH$_2$) | SEQ ID NO: 57 |

TABLE 4-continued

Exemplary compounds: GLP-1 receptor agonist polypeptides covalently bound to a lipophilic substituent, optionally via a spacer

| Compound No. | Sequence | SEQ ID NO: |
|---|---|---|
| A58 | H(Aib)EGTFTSDLSKQYEK*(γGlu-γGlu-dpeg-CO(CH$_2$)$_{18}$CO$_2$H)EAVRLFIEWLKDGGPSSGAPPPS-(NH$_2$) | SEQ ID NO: 58 |
| A59 | H(Aib)EGTFTSDLSKQYEK*(γGlu-γGlu-dpeg-CO(CH$_2$)$_{18}$CO$_2$H)EAVRLFIEWLKKGGPSSGAPPPS-(NH$_2$) | SEQ ID NO: 59 |
| A60 | H(Aib)EGTFTSDLSKQYEK*(γGlu-γGlu-dpeg-CO(CH$_2$)$_{18}$CO$_2$H)EAVRLFIEWLKSGGPSSGAPPPS-(NH$_2$) | SEQ ID NO: 60 |
| A61 | H(Aib)EGTFTSDLSKQYEK*(γGlu-γGlu-dpeg-CO(CH$_2$)$_{18}$CO$_2$H)EAAREFISWLKNGGPHSGAPPPS-(NH$_2$) | SEQ ID NO: 61 |
| A62 | H(Aib)EGTFTSDLSKQYEK*(γGlu-γGlu-dpeg-CO(CH$_2$)$_{18}$CO$_2$H)EAARKFISWLKNGGPHSGAPPPS-(NH$_2$) | SEQ ID NO: 62 |
| A63 | H(Aib)EGTFTSDLSKQYEK*(γGlu-γGlu-dpeg-CO(CH$_2$)$_{18}$CO$_2$H)EAARKFIEWLKNGGPHSGAPPPS-(NH$_2$) | SEQ ID NO: 63 |
| A64 | H(Aib)EGTFTSDLSKQYEK*(γGlu-γGlu-dpeg-CO(CH$_2$)$_{18}$CO$_2$H)EAARQFISWLKNGGPHSGAPPPS-(NH$_2$) | SEQ ID NO: 64 |
| A65 | H(Aib)EGTFTSDLSKQYEK*(γGlu-γGlu-dpeg-γGlu-γGlu-CO(CH$_2$)$_{18}$CO$_2$H)EAAREFIEWLKNGGPKSGAPPPS-(NH$_2$) | SEQ ID NO: 65 |
| A66 | H(Aib)EGTFTSDLSKQYEK*(γGlu-γGlu-dpeg-γGlu-γGlu-CO(CH$_2$)$_{18}$CO$_2$H)EAAREFIEWLKNGGPDapSGAPPPS-(NH$_2$) | SEQ ID NO: 66 |
| A67 | H(Aib)EGTYTSDLSKQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 67 |
| A68 | H(Aib)EGTFTSDLSQQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 68 |
| A69 | H(Aib)EGTFTSDLSSQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 69 |
| A70 | H(Aib)EGTFTSDLSEQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 70 |
| A71 | H(Aib)EGTFTSDLSKQYE(Dap)*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 71 |
| A72 | H(Aib)EGTFTSDLSKQYE(Dab)*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 72 |
| A73 | H(Aib)EGTFTSDLSKQYE(Orn)*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 73 |
| A74 | H(Aib)EGTFTSDLSKQYEK*(γGlu-γGlu-dpeg-CO(CH$_2$)$_{18}$CO$_2$H)KAVRLFISWLKNGGPSSGAPPPS-(NH$_2$) | SEQ ID NO: 74 |
| A75 | H(Aib)EGTFTSDLSKQYEK*(γGlu-γGlu-dpeg-CO(CH$_2$)$_{18}$CO$_2$H)EYVRLFISWLKNGGPSSGAPPPS-(NH$_2$) | SEQ ID NO: 75 |
| A76 | H(Aib)EGTFTSDLSKQYEK*(γGlu-γGlu-dpeg-CO(CH$_2$)$_{18}$CO$_2$H)EAAREFIEWLKNGGPSSGAPPPS-(NH$_2$) | SEQ ID NO: 76 |
| A77 | H(Aib)EGTFTSDLSKQYEK*(γGlu-γGlu-dpeg-CO(CH$_2$)$_{18}$CO$_2$H)EAARKFISWLKNGGPSSGAPPPS-(NH$_2$) | SEQ ID NO: 77 |
| A78 | H(Aib)EGTFTSDLSKQYEK*(γGlu-γGlu-dpeg-CO(CH$_2$)$_{18}$CO$_2$H)EAVREFISWLKNGGPSSGAPPPS-(NH$_2$) | SEQ ID NO: 78 |
| A79 | H(Aib)EGTFTSDVSEQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 79 |
| A80 | H(Aib)EGTFTSDISEQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 80 |
| A81 | H(Aib)EGTFTNDLSEQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 81 |
| A82 | H(Aib)EGTFTNDVSEQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 82 |

TABLE 4-continued

Exemplary compounds: GLP-1 receptor agonist polypeptides covalently bound to a lipophilic substituent, optionally via a spacer

| Compound No. | Sequence | SEQ ID NO: |
|---|---|---|
| A83 | H(Aib)EGTFTNDISEQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 83 |
| A84 | H(Aib)EGTFSSDLSEQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 84 |
| A85 | H(Aib)EGTFTSDVSKQYEK*(γGlu-γGlu-dpeg-CO(CH$_2$)$_{18}$CO$_2$H)EAARLFISWLKNGGPSSGAPPPS-(NH$_2$) | SEQ ID NO: 85 |
| A86 | H(Aib)EGTFTSDISKQYEK*(γGlu-γGlu-dpeg-CO(CH$_2$)$_{18}$CO$_2$H)EAARLFISWLKNGGPSSGAPPPS-(NH$_2$) | SEQ ID NO: 86 |
| A87 | H(Aib)EGTFTNDLSKQYEK*(γGlu-γGlu-dpeg-CO(CH$_2$)$_{18}$CO$_2$H)EAARLFISWLKNGGPSSGAPPPS-(NH$_2$) | SEQ ID NO: 87 |
| A88 | H(Aib)EGTFTNDVSKQYEK*(γGlu-γGlu-dpeg-CO(CH$_2$)$_{18}$CO$_2$H)EAARLFISWLKNGGPSSGAPPPS-(NH$_2$) | SEQ ID NO: 88 |
| A89 | H(Aib)EGTFTNDISKQYEK*(γGlu-γGlu-dpeg-CO(CH$_2$)$_{18}$CO$_2$H)EAARLFISWLKNGGPSSGAPPPS-(NH$_2$) | SEQ ID NO: 89 |
| A90 | H(Aib)EGTFTSDLSKQYEK*(γGlu-γGlu-dpeg-CO(CH$_2$)$_{18}$CO$_2$H)KAVREFISWLKNGGPSSGAPPPS-(NH$_2$) | SEQ ID NO: 90 |
| A91 | H(Aib)EGTFTSDLSKQYEK*(γGlu-γGlu-dpeg-CO(CH$_2$)$_{18}$CO$_2$H)KAARLFISWLKNGGPSSGAPPPS-(NH$_2$) | SEQ ID NO: 91 |
| A92 | H(Aib)EGTFTSDLSKQYEK*(γGlu-γGlu-dpeg-CO(CH$_2$)$_{18}$CO$_2$H)KYVRLFISWLKNGGPSSGAPPPS-(NH$_2$) | SEQ ID NO: 92 |
| A93 | H(Aib)EGTFTSDLSKQYEK*(γGlu-γGlu-dpeg-CO(CH$_2$)$_{18}$CO$_2$H)KYARLFISWLKNGGPSSGAPPPS-(NH$_2$) | SEQ ID NO: 93 |
| A94 | H(Aib)EGTFTSDLSKQYEK*(γGlu-γGlu-dpeg-CO(CH$_2$)$_{18}$CO$_2$H)KYAREFISWLKNGGPSSGAPPPS-(NH$_2$) | SEQ ID NO: 94 |
| A95 | H(Aib)EGTFTSDLSKQYEK*(γGlu-γGlu-dpeg-CO(CH$_2$)$_{18}$CO$_2$H)KYAEEFISWLKNGGPSSGAPPPS-(NH$_2$) | SEQ ID NO: 95 |
| A96 | H(Aib)EGTFTSDLSKQYEK*(γGlu-γGlu-dpeg-CO(CH$_2$)$_{18}$CO$_2$H)EAVRQFISWLKNGGPSSGAPPPS-(NH$_2$) | SEQ ID NO: 96 |
| A97 | H(Aib)EGTFTSDLSKQYEK*(γGlu-γGlu-dpeg-CO(CH$_2$)$_{18}$CO$_2$H)EYAREFISWLKNGGPSSGAPPPS-(NH$_2$) | SEQ ID NO: 97 |
| A98 | H(Aib)EGTFTSDLSKQYEK*(γGlu-γGlu-dpeg-CO(CH$_2$)$_{18}$CO$_2$H)KAAREFISWLKNGGPSSGAPPPS-(NH$_2$) | SEQ ID NO: 98 |
| A99 | H(Aib)EGTFTSDLSKQYEK*(γGlu-γGlu-dpeg-CO(CH$_2$)$_{18}$CO$_2$H)KSAREFISWLKNGGPSSGAPPPS-(NH$_2$) | SEQ ID NO: 99 |
| A100 | H(Aib)EGTFTSDLSKQYEK*(γGlu-γGlu-dpeg-CO(CH$_2$)$_{18}$CO$_2$H)QAAREFISWLKNGGPSSGAPPPS-(NH$_2$) | SEQ ID NO: 100 |
| A101 | H(Aib)EGTFTSDLSKQYEK*(γGlu-γGlu-dpeg-CO(CH$_2$)$_{18}$CO$_2$H)QYAREFISWLKNGGPSSGAPPPS-(NH$_2$) | SEQ ID NO: 101 |
| A102 | H(Aib)EGTFTSDLSKQYEK*(γGlu-γGlu-dpeg-CO(CH$_2$)$_{18}$CO$_2$H)QSAREFISWLKNGGPSSGAPPPS-(NH$_2$) | SEQ ID NO: 102 |
| A103 | H(Aib)EGTFTNDVSKQYEK*(γGlu-γGlu-dpeg-CO(CH$_2$)$_{18}$CO$_2$H)EAAREFISWLKNGGPSSGAPPPS-(NH$_2$) | SEQ ID NO: 103 |
| A104 | H(Aib)EGTFTNDVSKQYEK*(γGlu-γGlu-dpeg-CO(CH$_2$)$_{18}$CO$_2$H)EAVREFISWLKNGGPSSGAPPPS-(NH$_2$) | SEQ ID NO: 104 |
| A105 | H(Aib)EGTFTSDISKQYEK*(γGlu-γGlu-dpeg-CO(CH$_2$)$_{18}$CO$_2$H)EAVRQFIEWLKNGGPSSGAPPPS-(NH$_2$) | SEQ ID NO: 105 |

TABLE 4-continued

Exemplary compounds: GLP-1 receptor agonist polypeptides covalently bound to a lipophilic substituent, optionally via a spacer

| Compound No. | Sequence | SEQ ID NO: |
|---|---|---|
| A106 | H(Aib)EGTFTSDISKQYEK*(γGlu-γGlu-dpeg-CO(CH$_2$)$_{18}$CO$_2$H)EAARQFIEWLKNGGPSSGAPPPS-(NH$_2$) | SEQ ID NO: 106 |
| A107 | H(Aib)EGTFTNDISKQYEK*(γGlu-γGlu-dpeg-CO(CH$_2$)$_{18}$CO$_2$H)EAAREFISWLKNGGPSSGAPPPS-(NH$_2$) | SEQ ID NO: 107 |
| A108 | H(Aib)EGTFTNDISKQYEK*(γGlu-γGlu-dpeg-CO(CH$_2$)$_{18}$CO$_2$H)EAVREFISWLKNGGPSSGAPPPS-(NH$_2$) | SEQ ID NO: 108 |
| A109 | H(Aib)EGTFTNDISKQYEK*(γGlu-γGlu-dpeg-CO(CH$_2$)$_{18}$CO$_2$H)EAVRQFIEWLKNGGPSSGAPPPS-(NH$_2$) | SEQ ID NO: 109 |
| A110 | H(Aib)EGTFTNDISKQYEK*(γGlu-γGlu-dpeg-CO(CH$_2$)$_{18}$CO$_2$H)EAARQFIEWLKNGGPSSGAPPPS-(NH$_2$) | SEQ ID NO: 110 |
| A111 | H(Aib)EGTFTSDISKQYEK*(Glu-γGlu-dpeg-CO(CH$_2$)$_{18}$CO$_2$H)EAARKFISWLKNGGPSSGAPPPS-(NH$_2$) | SEQ ID NO: 111 |
| A112 | H(Aib)EGTFTNDISKQYEK*(γGlu-γGlu-dpeg-CO(CH$_2$)$_{18}$CO$_2$H)EAARKFISWLKNGGPSSGAPPPS-(NH$_2$) | SEQ ID NO: 112 |
| A113 | H(Aib)EGTFTNDLSKQYEK*(γGlu-γGlu-dpeg-CO(CH$_2$)$_{18}$CO$_2$H)EAARKFISWLKNGGPSSGAPPPS-(NH$_2$) | SEQ ID NO: 113 |
| A114 | H(Aib)EGTFTNDVSKQYEK*(γGlu-γGlu-dpeg-CO(CH$_2$)$_{18}$CO$_2$H)EAARKFISWLKNGGPSSGAPPPS-(NH$_2$) | SEQ ID NO: 114 |
| A115 | H(Aib)EGTFTSDVSKQYEK*(γGlu-γGlu-dpeg-CO(CH$_2$)$_{18}$CO$_2$H)EAARKFISWLKNGGPSSGAPPPS-(NH$_2$) | SEQ ID NO: 115 |
| A116 | H(Aib)EGTFTNDISKQYEK*(γGlu-γGlu-dpeg-CO(CH$_2$)$_{18}$CO$_2$H)EYAREFISWLKNGGPSSGAPPPS-(NH$_2$) | SEQ ID NO: 116 |
| A117 | H(Aib)EGTFTSDLSKQYEK*(γGlu-γGlu-dpeg-CO(CH$_2$)$_{18}$CO$_2$H)E$^+$AARK$^+$FISWLKNGGPSSGAPPPS-(NH$_2$) | SEQ ID NO: 117 |
| A118 | H(Aib)EGTFTSDLSKQYEK*(γGlu-γGlu-dpeg-CO(CH$_2$)$_{18}$CO$_2$H)K$^+$AARE$^+$FISWLKNGGPSSGAPPPS-(NH$_2$) | SEQ ID NO: 118 |
| A119 | H(Aib)EGTFTSDLSKQYEK*(γGlu-γGlu-dpeg-CO(CH$_2$)$_{18}$CO$_2$H)EAARE$^+$FISWLKK$^+$GGPSSGAPPPS-(NH$_2$) | SEQ ID NO: 119 |
| A120 | H(Aib)EGTFTSDLSKQYEK*(γGlu-γGlu-dpeg-CO(CH$_2$)$_{18}$CO$_2$H)EAAK$^+$KFIE$^+$WLKNGGPSSGAPPPS-(NH$_2$) | SEQ ID NO: 120 |
| A121 | H(Aib)EGTFTSDLSKQYEK*(γGlu-γGlu-dpeg-CO(CH$_2$)$_{18}$CO$_2$H)EAAE$^+$EFIK$^+$WLKNGGPSSGAPPPS-(NH$_2$) | SEQ ID NO: 121 |
| A122 | H(Aib)EGTFTSDLSKQMEEEAVRK*(γGlu-γGlu-dpeg-CO(CH$_2$)$_{18}$CO$_2$H)FISWLKNGGPSSGAPPPS-(NH$_2$) | SEQ ID NO: 122 |
| A123 | H(Aib)EGTFTSDLSKQYEEEAVK*(γGlu-γGlu-dpeg-CO(CH$_2$)$_{18}$CO$_2$H)EFISWLKNGGPSSGAPPPS-(NH$_2$) | SEQ ID NO: 123 |
| A124 | H(Aib)EGTFTSDLSKQMEEEAVK*(γGlu-γGlu-dpeg-CO(CH$_2$)$_{18}$CO$_2$H)EFISWLKNGGPSSGAPPPS-(NH$_2$) | SEQ ID NO: 124 |
| A125 | H(Aib)EGTFTSDLSKQMEEEAK*(γGlu-γGlu-dpeg-CO(CH$_2$)$_{18}$CO$_2$H)REFISWLKNGGPSSGAPPPS-(NH$_2$) | SEQ ID NO: 125 |
| A126 | H(Aib)EGTFTSDLSKQYEEEAVK*(γGlu-γGlu-dpeg-CO(CH$_2$)$_{18}$CO$_2$H)EFISWLKNGGPSSGAPPPS-NH$_2$ | SEQ ID NO: 126 |
| A127 | H(Aib)EGTFTSDLSKQYEEEAAK*(γGlu-γGlu-dpeg-CO(CH$_2$)$_{18}$CO$_2$H)KFISWLKNGGPSSGAPPPS-(NH$_2$) | SEQ ID NO: 127 |
| A128 | H(Aib)EGTFTSDLSKQYEEKYAK*(γGlu-γGlu-dpeg-CO(CH$_2$)$_{18}$CO$_2$H)EFISWLKNGGPSSGAPPPS-(NH$_2$) | SEQ ID NO: 128 |
| A129 | H(Aib)EGTFTSDLSKQYEEKYKK*(γGlu-γGlu-dpeg-CO(CH$_2$)$_{18}$CO$_2$H)EFISWLKNGGPSSGAPPPS-(NH$_2$) | SEQ ID NO: 129 |
| A130 | H(Aib)EGTFTSDLSKQYEEEAVK*(γGlu-γGlu-dpeg-CO(CH$_2$)$_{18}$CO$_2$H)EFISWLKQGGPSSGAPPPS-(NH$_2$) | SEQ ID NO: 130 |

TABLE 4-continued

Exemplary compounds: GLP-1 receptor agonist polypeptides covalently bound to a lipophilic substituent, optionally via a spacer

| Compound No. | Sequence | SEQ ID NO: |
|---|---|---|
| A131 | H(Aib)EGTFTSDLSKQYEEEAAK*(γGlu-γGlu-dpeg-CO(CH$_2$)$_{18}$CO$_2$H)KFISWLKQGGPSSGAPPPS-(NH$_2$) | SEQ ID NO: 131 |
| A132 | H(Aib)EGTFTSDVSKQYEK*(γGlu-γGlu-dpeg-CO(CH$_2$)$_{18}$CO$_2$H)EAVRKFISWLKNGGPSSGAPPPS-(NH$_2$) | SEQ ID NO: 132 |
| A133 | H(Aib)EGTFTSDISKQYEK*(γGlu-γGlu-dpeg-CO(CH$_2$)$_{18}$CO$_2$H)EAVREFISWLKNGGPSSGAPPPS-(NH$_2$) | SEQ ID NO: 133 |
| A134 | H(Aib)EGTFTSDISKQYEK*(γGlu-γGlu-dpeg-CO(CH$_2$)$_{18}$CO$_2$H)EAVRKFISWLKNGGPSSGAPPPS-(NH$_2$) | SEQ ID NO: 134 |
| A135 | H(Aib)EGTFTSDVSKQYEK*(γGlu-γGlu-dpeg-CO(CH$_2$)$_{18}$CO$_2$H)EAVK⁺KFIE⁺WLKNGGPSSGAPPPS-(NH$_2$) | SEQ ID NO: 135 |
| A136 | H(Aib)EGTFTSDISKQYEK*(γGlu-γGlu-dpeg-CO(CH$_2$)$_{18}$CO$_2$H)EAVK⁺EFIE⁺WLKNGGPSSGAPPPS-(NH$_2$) | SEQ ID NO: 136 |
| A137 | H(Aib)EGTFTSDVSKQYEK*(γGlu-γGlu-dpeg-CO(CH$_2$)$_{18}$CO$_2$H)EAAK⁺KFIE⁺WLKNGGPSSGAPPPS-(NH$_2$) | SEQ ID NO: 137 |
| A138 | H(Aib)EGTFTSDVSKQYEK*(γGlu-γGlu-dpeg-CO(CH$_2$)$_{18}$CO$_2$H)EAAK⁺KFIE⁺WLKQGGPSSGAPPPS-(NH$_2$) | SEQ ID NO: 138 |
| A139 | H(Aib)EGTFTSDVSKQYEK*(γGlu-γGlu-dpeg-CO(CH$_2$)$_{18}$CO$_2$H)EAARKFISWLKQGGPSSGAPPPS-(NH$_2$) | SEQ ID NO: 139 |
| A140 | H(Aib)EGTFTSDVSKQYEK*(γGlu-γGlu-dpeg-CO(CH$_2$)$_{18}$CO$_2$H)EAVK⁺KFIE⁺WLKQGGPSSGAPPPS-(NH$_2$) | SEQ ID NO: 140 |
| A141 | H(Aib)EGTFTSDVSKQYEK*(γGlu-γGlu-dpeg-CO(CH$_2$)$_{18}$CO$_2$H)K⁺AARE⁺FISWLKNGGPSSGAPPPS-(NH$_2$) | SEQ ID NO: 141 |
| A142 | H(Aib)EGTFTSDLSKQYEK*(γGlu-γGlu-dpeg-CO(CH$_2$)$_{18}$CO$_2$H)EAVRKFIEWLKNGGPSSGAPPPS-(NH$_2$) | SEQ ID NO: 142 |
| A143 | H(Aib)EGTFTSDLSKQYEK*(γGlu-γGlu-dpeg-γGlu-γGlu-CO(CH$_2$)$_{18}$CO$_2$H)EAVRLFIEWLKNGGPSSGAPPPS-(NH$_2$) | SEQ ID NO: 143 |
| A144 | HGEGTFTSDLSKQYEK*(γGlu-γGlu-dpeg-γGlu-γGlu,CO(CH$_2$)$_{18}$CO$_2$H)EAVRLFISWLKNGGPSSGAPPPS-(NH$_2$) | SEQ ID NO: 144 |
| A145 | H(Aib)EGTFTSDLSKQYEK*(γGlu-γGlu-dpeg-γGlu-γGlu-CO(CH$_2$)$_{18}$CO$_2$H)EAVRLFIEWLKNGGPHSGAPPPS-(NH$_2$) | SEQ ID NO: 145 |
| A146 | H(Aib)EGTFTSDLSKQYEK*(γGlu-γGlu-dpeg-γGlu-γGlu-CO(CH$_2$)$_{18}$CO$_2$H)EAARLFIEWLKNGGPSSGAPPPS-(NH$_2$) | SEQ ID NO: 146 |
| A147 | H(Aib)EGTFTSDLSKQYEK*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 147 |
| A148 | H(Aib)EGTFTSDLSKQYEK*(γGlu-γGlu-dpeg-γGlu-γGlu-CO(CH$_2$)$_{18}$CO$_2$H)EAARKFIEWLKNGGPSSGAPPPS-(NH$_2$) | SEQ ID NO: 148 |
| A149 | H(Aib)EGTFTSDLSKQYEK*(γGlu-γGlu-dpeg-γGlu-γGlu-CO(CH$_2$)$_{18}$CO$_2$H)EAARLFIEWLKNGGPHSGAPPPS-(NH$_2$) | SEQ ID NO: 149 |
| A150 | H(Aib)EGTFTSDLSKQYEK*(γGlu-γGlu-dpeg-γGlu-γGlu-CO(CH$_2$)$_{18}$CO$_2$H)EAARKFIEWLKNGGPHSGAPPPS-(NH$_2$) | SEQ ID NO: 150 |
| A151 | H(Aib)EGTFTSDLSKQYEK*(γGlu-γGlu-dpeg-CO(CH$_2$)$_{18}$CO$_2$H)EAVRKFIEWLKNGGPHSGAPPPS-(NH$_2$) | SEQ ID NO: 151 |
| A152 | H(Aib)EGTFTSDLSKQYEK*(γGlu-γGlu-dpeg-CO(CH$_2$)$_{18}$CO$_2$H)EAVREFIEWLKNGGPHSGAPPPS-(NH$_2$) | SEQ ID NO: 152 |
| A153 | H(Aib)EGTFTSDLSKQYEK*(γGlu-γGlu-dpeg-CO(CH$_2$)$_{18}$CO$_2$H)EAVRQFIEWLKNGGPHSGAPPPS-(NH$_2$) | SEQ ID NO: 153 |
| A154 | H(Aib)EGTFTSDLSKQYEK*(γGlu-γGlu-dpeg-γGlu-γGlu-CO(CH$_2$)$_{18}$CO$_2$H)EAAREFIEWLKNGGPHSGAPPPS-(NH$_2$) | SEQ ID NO: 154 |

TABLE 4-continued

Exemplary compounds: GLP-1 receptor agonist polypeptides covalently bound to a lipophilic substituent, optionally via a spacer

| Compound No. | Sequence | SEQ ID NO: |
|---|---|---|
| A155 | H(Aib)EGTFTSDLSKQYEK*(γGlu-γGlu-dpeg-γGlu-γGlu-CO(CH$_2$)$_{18}$CO$_2$H)EAARQFIEWLKNGGPHSGAPPPS-(NH$_2$) | SEQ ID NO: 155 |
| A156 | H(Aib)EGTFTSDLSKQYEK*(γGlu-γGlu-dpeg-γGlu-γGlu-CO(CH$_2$)$_{18}$CO$_2$H)EAVRLFISWLKNGGPHSGAPPPS-(NH$_2$) | SEQ ID NO: 156 |
| A157 | H(Aib)EGTFTSDLSKQYEK*(γGlu-γGlu-dpeg-CO(CH$_2$)$_{18}$CO$_2$H)EAAREFISWLKNGGPSSGAPPPS-(NH$_2$) | SEQ ID NO: 157 |
| A158 | H(Aib)EGTFTSDLSKQYEK*(γGlu-γGlu-dpeg-CO(CH$_2$)$_{18}$CO$_2$H)EAVRKFISWLKNGGPSSGAPPPS-(NH$_2$) | SEQ ID NO: 158 |
| A159 | H(Aib)EGTFTSDLSEQYE(Dap)*(γGlu-γGlu-dpeg-γGlu-γGlu-CO(CH$_2$)$_{18}$CO$_2$H)EAAREFIEWLKNGGPSSGAPPPS-(NH$_2$) | SEQ ID NO: 159 |
| A160 | H(Aib)EGTFTSDLSEQYE(Dap)*(γGlu-γGlu-DPEG-γGlu-γGlu-CO(CH$_2$)$_{18}$CO$_2$H)EAARLFIEWLKNGGPSSGAPPPS-(NH$_2$) | SEQ ID NO: 160 |
| A161 | H(Aib)EGTFTSDLSEQYEK*(Glu-γGlu-dpeg-γGlu-γGlu-CO(CH$_2$)$_{18}$CO$_2$H)EAARLFIEWLKNGGPSSGAPPPS-(NH$_2$) | SEQ ID NO: 161 |
| A162 | H(Aib)EGTFTEDLSKQYEK*(γGlu-dpeg-CO(CH$_2$)$_{18}$CO$_2$H)EAVRLFISWLKNGGPSSGAPPPS-(NH$_2$) | SEQ ID NO: 162 |

TABLE 5

Chemical structures of exemplary compounds: GLP-1 receptor agonist polypeptides comprising a lipophilic substituent via a spacer, one compound of which further comprises a bridging moiety.

HGEGTFTSDLSKQMEK*(dpeg-dpeg-γGlu-CO(CH$_2$)$_{16}$CO$_2$H)EAVRLFIEWLKNGGPSSGAPPPS-(NH$_2$)
A6
SEQ ID NO: 6

H(Aib)EGTFTSDLSKQYEK*(γGlu-γGlu-dpeg-CO(CH$_2$)$_{18}$CO$_2$H)EAVRLFISWLKNGGPSSGAPPPS-(NH$_2$)
A45
SEQ ID NO: 45

H(Aib)EGTFTSDLSKQYEK*(γGlu-γGlu-dpeg-CO(CH$_2$)$_{18}$CO$_2$H)EAVRLFIEWLKNGGPSSGAPPPS-(NH$_2$)
A46
SEQ ID NO: 46

TABLE 5-continued

Chemical structures of exemplary compounds: GLP-1 receptor agonist polypeptides comprising a lipophilic substituent via a spacer, one compound of which further comprises a bridging moiety.

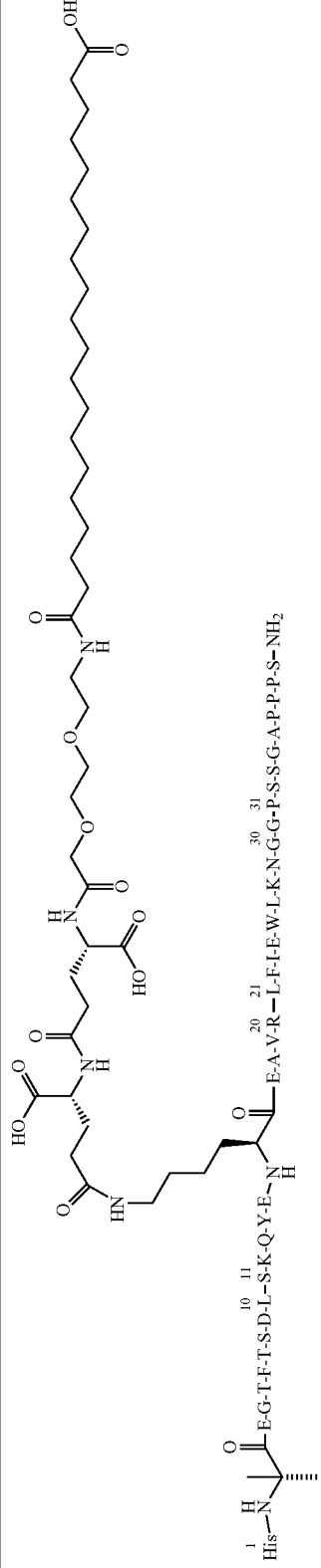

H(Aib)EGTFTSDLSKQYEK*(γGlu-γGlu-dpeg-CO(CH$_2$)$_{18}$CO$_2$H)EAVREFIEWLKNGGPSSGAPPPS-(NH$_2$)
A54
SEQ ID NO: 54

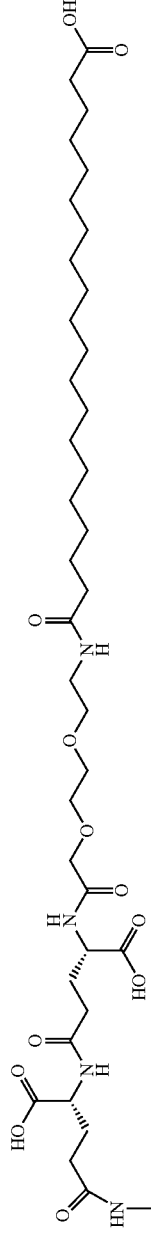

H(Aib)EGTFTSDLSKQYEK*(γGlu-γGlu-dpcg-CO(CH$_2$)$_{18}$CO$_2$H)EAVRQFIEWLKNGGPSSGAPPPS-(NH$_2$)
A55
SEQ ID NO: 55

TABLE 5-continued

Chemical structures of exemplary compounds: GLP-1 receptor agonist polypeptides comprising a lipophilic substituent via a spacer, one compound of which further comprises a bridging moiety.

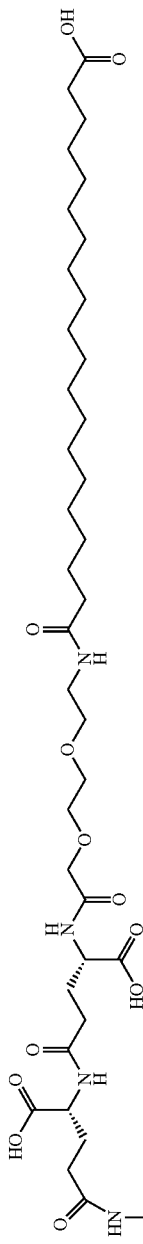
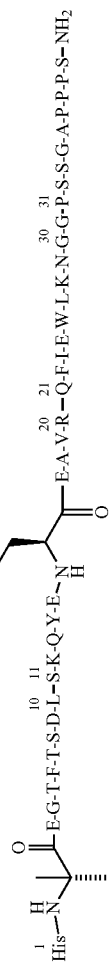

H(Aib)EGTFTSDLSKQYEK*(γGlu-γGlu-dpeg-CO(CH$_2$)$_{18}$CO$_2$H)EAARKFISWLKNGGPSSGAPPPS-(NH$_2$)

A77

SEQ ID NO: 77

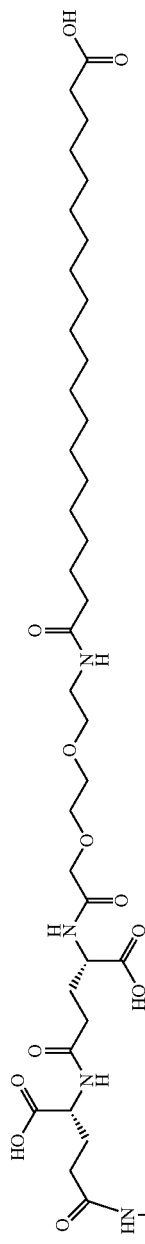
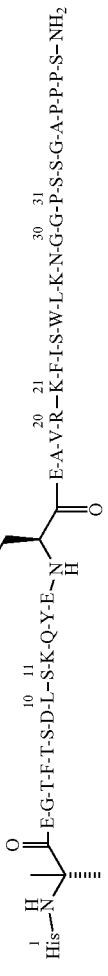

H(Aib)EGTFTSDLSKQYEK*(γGlu-γGlu-dpeg-CO(CH$_2$)$_{18}$CO$_2$H)EAVREFISWLKNGGPSSGAPPPS-(NH$_2$)

A78

SEQ ID NO: 78

TABLE 5-continued

Chemical structures of exemplary compounds: GLP-1 receptor agonist polypeptides comprising a lipophilic substituent via a spacer, one compound of which further comprises a bridging moiety.

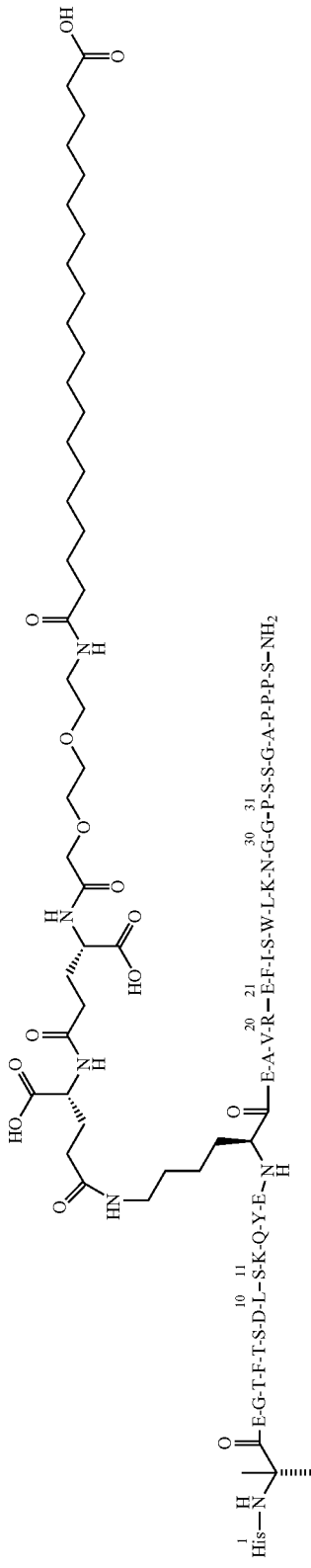

H(Aib)EGTFTDSDISKQYEK*(γGlu-γGlu-dpeg-CO(CH$_2$)$_{18}$CO$_2$H)EAVREFISWLKNGGPSSGAPPPS-(NH$_2$)
A108
SEQ ID NO: 108

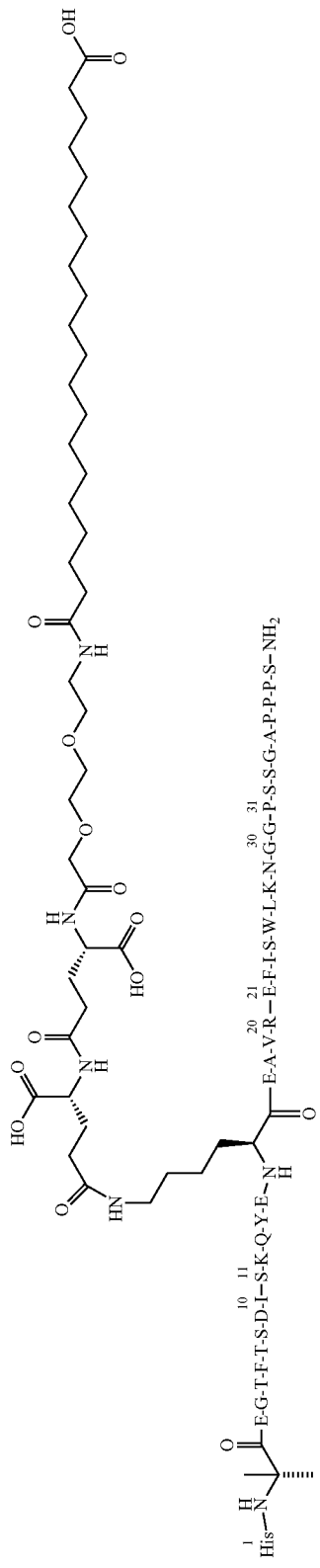

H(Aib)EGTFTDSDISKQYEK*(γGlu-γGlu-dpeg-CO(CH$_2$)$_{18}$CO$_2$H)EAARKFISWLKNGGPSSGAPPPS-(NH$_2$)
A111
SEQ ID NO: 111

TABLE 5-continued

Chemical structures of exemplary compounds: GLP-1 receptor agonist polypeptides comprising a lipophilic substituent via a spacer, one compound of which further comprises a bridging moiety.

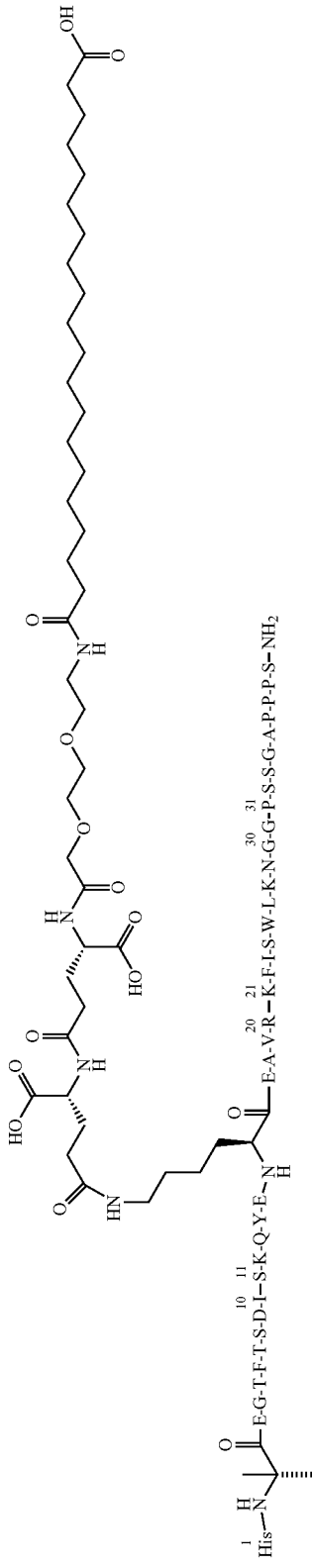

H(Aib)EGTFTNDISKQYEK*(γGlu-γGlu-dpeg-CO(CH$_2$)$_{18}$CO$_2$H)EAARKFISWLKNGGPSSGAPPPS-(NH$_2$)
A112
SEQ ID NO: 112

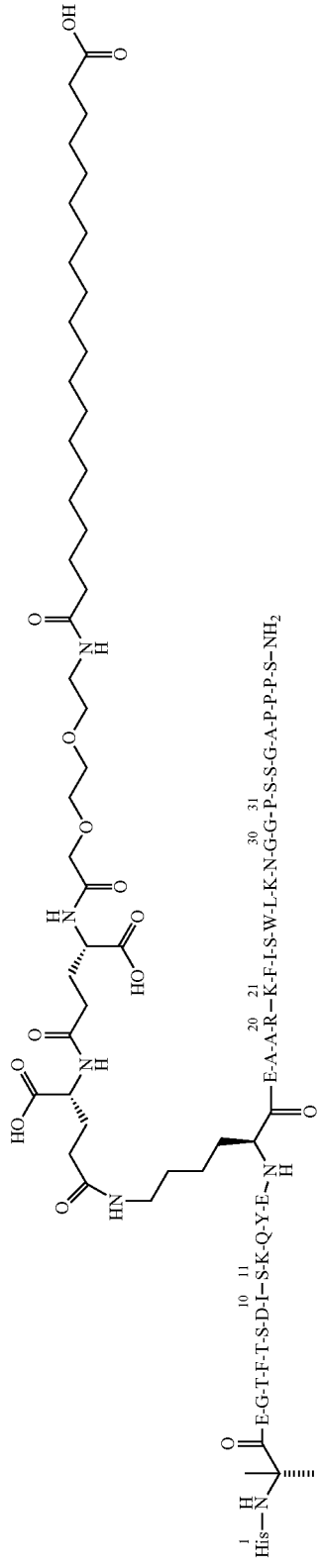

H(Aib)EGTFTNDVSKQYEK*(γGlu-γGlu-dpeg-CO(CH$_2$)$_{18}$CO$_2$H)EAARKFISWLKNGGPSSGAPPPS-(NH$_2$)
A114
SEQ ID NO: 114

TABLE 5-continued

Chemical structures of exemplary compounds: GLP-1 receptor agonist polypeptides comprising a lipophilic substituent via a spacer, one compound of which further comprises a bridging moiety.

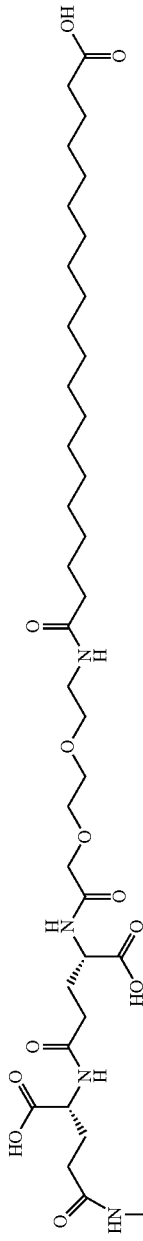

H(Aib)EGTFTSDVSKQYEK*(γGlu-γGlu-dpeg-CO(CH$_2$)$_{18}$CO$_2$H)EAARKFISWLKNGGPSSGAPPPS-(NH$_2$)
A115
SEQ ID NO: 115

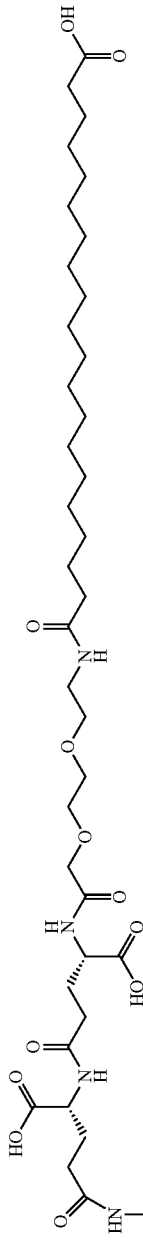

H(Aib)EGTFTSDLSKQYEK*(γGlu-γGlu-dpeg-CO(CH$_2$)$_{18}$CO$_2$H)EAAK'KFIE'WLKNGGPSSGAPPPS-(NH$_2$)
A120
SEQ ID NO: 120

TABLE 5-continued
Chemical structures of exemplary compounds: GLP-1 receptor agonist polypeptides comprising a lipophilic substituent via a spacer, one compound of which further comprises a bridging moiety.
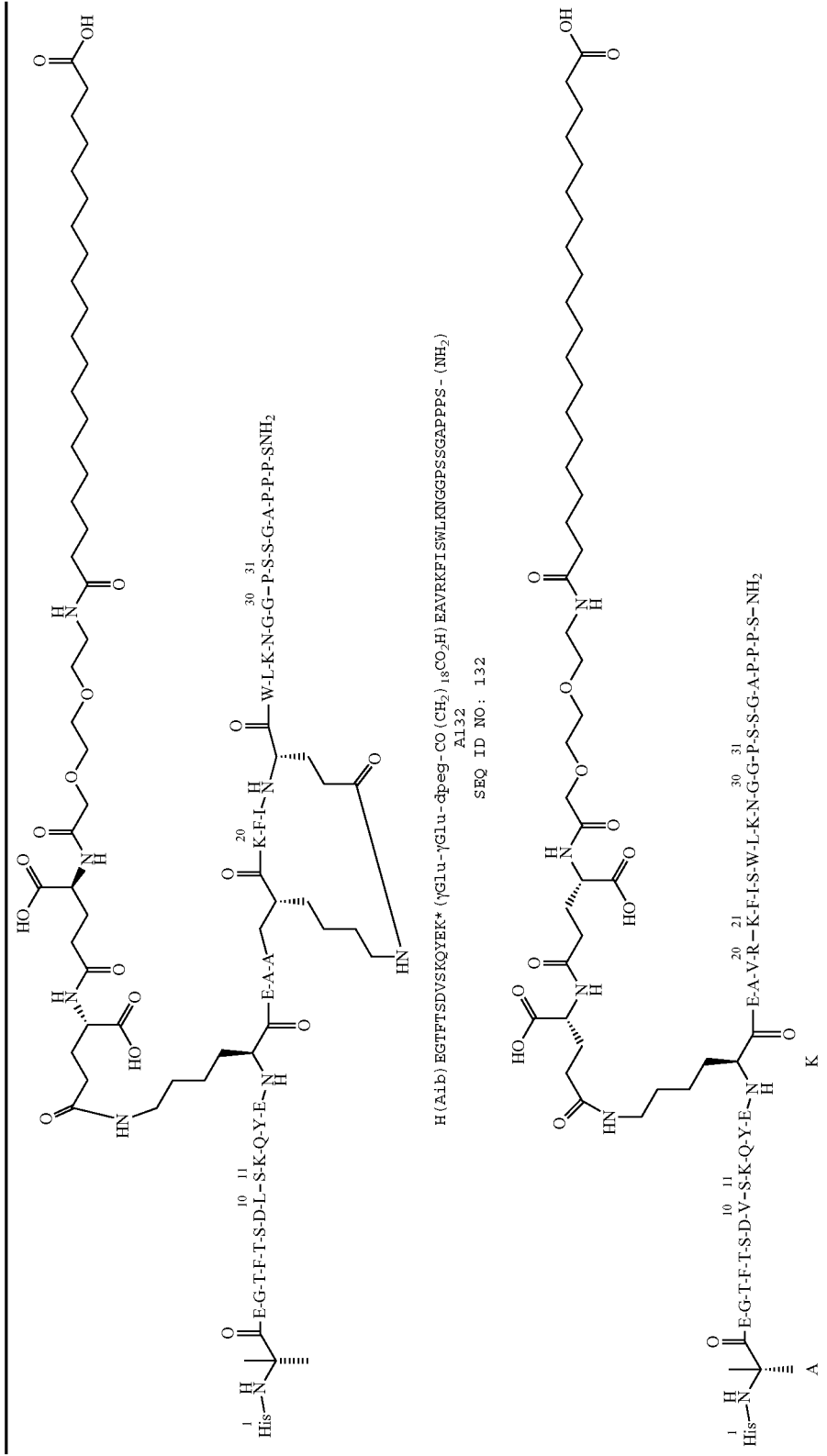

TABLE 5-continued

Chemical structures of exemplary compounds: GLP-1 receptor agonist polypeptides comprising a lipophilic substituent via a spacer, one compound of which further comprises a bridging moiety.

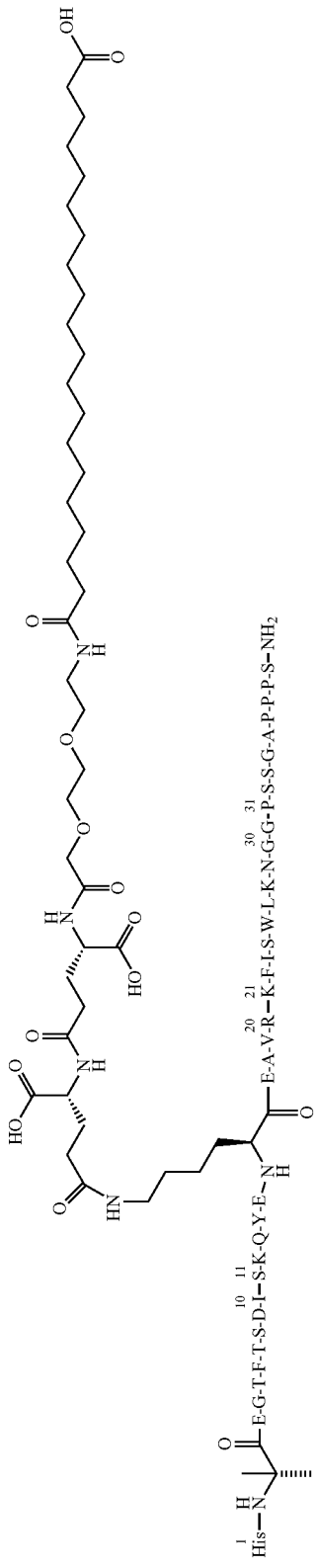

H(Aib)EGTFTSDVSKQYEK*(γGlu-γGlu-dpeg-CO(CH$_2$)$_{18}$CO$_2$H)EAARKFISWLKQGGPSSGAPPPS-(NH$_2$)
A139
SEQ ID NO: 139

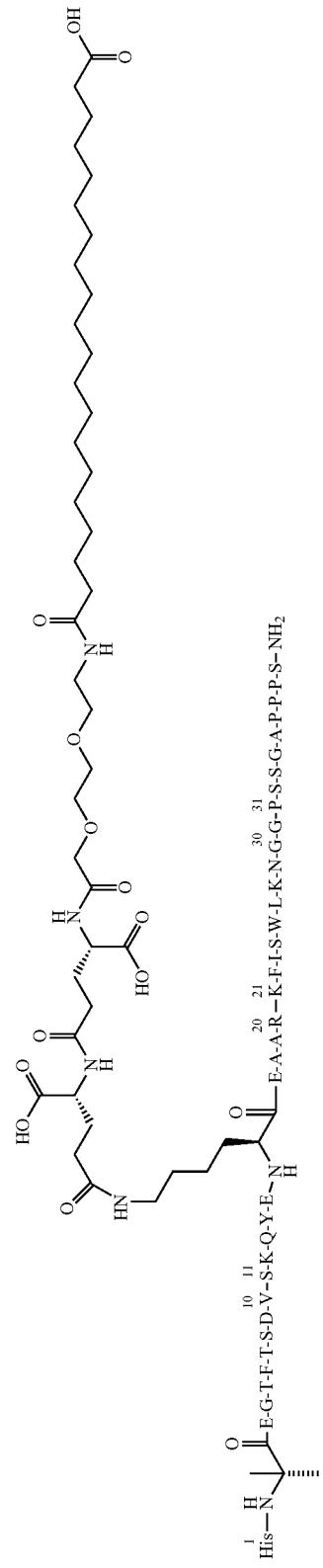

H(Aib)EGTFTEDLSKQYEK*(γGlu-dpeg-CO(CH$_2$)$_{18}$CO$_2$H)EAVRLFISWLKNGGPSSGAPPPS-(NH$_2$)
A162
SEQ ID NO: 162

TABLE 5-continued

Chemical structures of exemplary compounds: GLP-1 receptor agonist polypeptides comprising a lipophilic substituent via a spacer, one compound of which further comprises a bridging moiety.

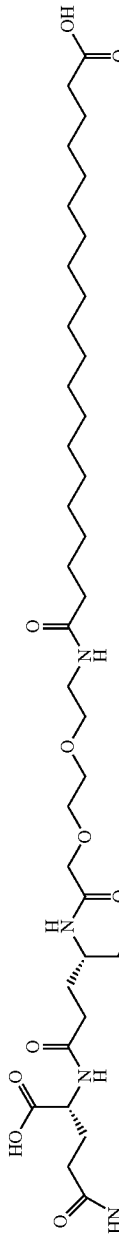
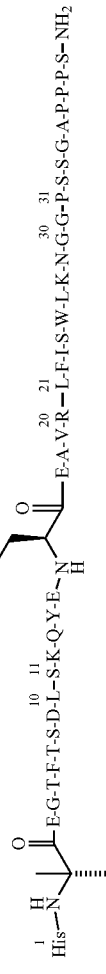
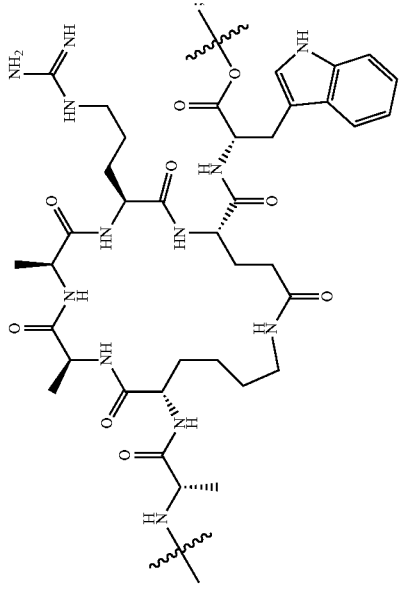

Notes:
each K* independently represents an L-lysine covalently bound to a lipophilic substituent, optionally via a spacer; each pairing of K⁺ and F⁺ represents a covalent amide linkage derived from the amino sidechain of K⁺ and the carboxy sidechain of F⁺ (with loss of a water molecule). For example, the segment -AK⁺AARF⁺W- (SEQ ID NO: 9128) represents:

as used herein, dpeg represents $-COCH_2O(CH_2)_2O(CH_2)_2NH-$; and dpeg-dpeg represents $-COCH_2O(CH_2)_2O(CH_2)_2NH-COCH_2O(CH_2)_2O(CH_2)_2NH-$; and carboxy terminal amino acid, i.e. S₃₉, shown as -S₃₉-(NH₂), depicts $-NH-CH(CH_2OH)-CONH_2$.

carboxy terminal amino acid, i.e. S$_{39}$, shown as —S$_{39}$—(NH$_2$), depicts —NH—CH(CH$_2$OH)—CONH$_2$.

In some embodiments, the isolated polypeptide comprises an amino acid sequence selected from the group consisting of SEQ ID NOs: 1 to 162. or a pharmaceutically acceptable salt thereof.

In some embodiments, the isolated polypeptide comprises an amino acid sequence selected from the group consisting of SEQ ID NOs: 6, 45, 46, 54, 55, 62, 68, 70, 71, 74, 75, 77, 78, 85, 86, 87, 88, 89, 92, 94, 103, 107, 108, 111, 112, 114, 115, 120, 132, 134, 139, 147, and 149.

In some embodiments, the isolated polypeptide comprises an amino acid sequence selected from the group consisting of SEQ ID NOs: 45, 46, 54, 55, 62, 68, 70, 74, 75, 77, 78, 85, 86, 87, 88, 89, 92, 94, 103, 107, 108, 111, 112, 114, 115, 120, 132, 134, 139, 147, and 149.

In some embodiments, the isolated polypeptide comprises an amino acid sequence selected from the group consisting of SEQ ID NOs: 6, 45, 46, 54, 55, 77, 78, 108, 111, 112, 114, 115, 120, 132, 134, and 139 or a pharmaceutically acceptable salt thereof.

In some embodiments, the isolated polypeptide comprises an amino acid sequence selected from the group consisting of SEQ ID NOs: 45, 46, 54, 55, 77, 78, 108, 111, 112, 114, 115, 120, 132, 134, and 139.

In some embodiments, the isolated polypeptide comprises an amino acid sequence selected from the group consisting of SEQ ID NOs: 55, 115, 120 and 132 or a pharmaceutically acceptable salt thereof.

In some embodiments, the isolated polypeptide comprises an amino acid sequence of SEQ ID NO: 55 or a pharmaceutically acceptable salt thereof. In some embodiments, the isolated polypeptide comprises an amino acid sequence of SEQ ID NO: 115 or a pharmaceutically acceptable salt thereof. In some embodiments, the isolated polypeptide comprises an amino acid sequence of SEQ ID NO: 120 or a pharmaceutically acceptable salt thereof. In some embodiments, the isolated polypeptide comprises an amino acid sequence of SEQ ID NO: 132 or a pharmaceutically acceptable salt thereof.

In some embodiments, the present invention provides a compound set forth in Table 4, above, or a pharmaceutically acceptable salt thereof. In some embodiments, the present invention provides an isolated polypeptide that comprises an amino acid sequence selected from the group consisting of SEQ ID NOs: 1 to 162 or a pharmaceutically acceptable salt thereof. In some embodiments the pharmaceutically acceptable salt is an acetate salt. In some embodiments the pharmaceutically acceptable salt is a trifluoroacetic acid (TFA) salt. In some embodiments the pharmaceutically acceptable salt is a hydrochloric acid (HCl) salt.

In one embodiment, the compound is the isolated polypeptide comprising an amino acid sequence of SEQ ID NO: 55 or a pharmaceutically acceptable salt thereof. In some embodiments, the compound is the acetate salt of the isolated polypeptide comprising an amino acid sequence of SEQ ID NO: 55. In some embodiments, the compound is the TFA salt of the isolated polypeptide comprising an amino acid sequence of SEQ ID NO: 55. In some embodiments, the compound is the HCl salt of the isolated polypeptide comprising an amino acid sequence of SEQ ID NO: 55.

In one embodiment, the compound is the isolated polypeptide comprising an amino acid sequence of SEQ ID NO: 115 or a pharmaceutically acceptable salt thereof. In some embodiments, the compound is the acetate salt of the isolated polypeptide comprising an amino acid sequence of SEQ ID NO: 115. In some embodiments, the compound is the TFA salt of the isolated polypeptide comprising an amino acid sequence of SEQ ID NO: 115. In some embodiments, the compound is the HCl salt of the isolated polypeptide comprising an amino acid sequence of SEQ ID NO: 115.

In one embodiment, the compound is the isolated polypeptide comprising an amino acid sequence of SEQ ID NO: 120 or a pharmaceutically acceptable salt thereof. In some embodiments, the compound is the acetate salt of the isolated polypeptide comprising an amino acid sequence of SEQ ID NO: 120. In some embodiments, the compound is the TFA salt of the isolated polypeptide comprising an amino acid sequence of SEQ ID NO: 120. In some embodiments, the compound is the HCl salt of the isolated polypeptide comprising an amino acid sequence of SEQ ID NO: 120.

In one embodiment, the compound is the isolated polypeptide comprising an amino acid sequence of SEQ ID NO: 132 or a pharmaceutically acceptable salt thereof. In some embodiments, the compound is the acetate salt of the isolated polypeptide comprising an amino acid sequence of SEQ ID NO: 132. In some embodiments, the compound is the TFA salt of the isolated polypeptide comprising an amino acid sequence of SEQ ID NO: 132. In some embodiments, the compound is the HCl salt of the isolated polypeptide comprising an amino acid sequence of SEQ ID NO: 132.

TABLE 6

Exemplary compounds: GLP-1 receptor agonist polypeptides optionally comprising a lipophilic substituent, optionally via a spacer; and optionally further comprising a bridging moiety.

| Compound No. | Sequence | SEQ ID NO: |
|---|---|---|
| B1 | HGEGTFTSDLSKQKEEEAVRLFIEWLKNGGPSSGAPPPS-(NH$_2$) | SEQ ID NO: 1001 |
| B2 | HGEGTFTSDLSKQMEEKAVRLFIEWLKNGGPSSGAPPPS-(NH$_2$) | SEQ ID NO: 1002 |
| B3 | HGEGTFTSDLSKQMEEEKVRLFIEWLKNGGPSSGAPPPS-(NH$_2$) | SEQ ID NO: 1003 |
| B4 | HGEGTFTSDLSKQMEEEAVKLFIEWLKNGGPSSGAPPPS-(NH$_2$) | SEQ ID NO: 1004 |
| B5 | HGEGTFTSDLSKQMEEEAVRKFIEWLKNGGPSSGAPPPS-(NH$_2$) | SEQ ID NO: 1005 |

TABLE 6-continued

Exemplary compounds: GLP-1 receptor agonist polypeptides optionally comprising a lipophilic substituent, optionally via a spacer; and optionally further comprising a bridging moiety.

| Compound No. | Sequence | SEQ ID NO: |
|---|---|---|
| B6 | HGEGTFTSDLSKQMEKEAVRLFIEWLKNGGPSSGAPP PS-(NH$_2$) | SEQ ID NO: 1006 |
| B13 | HGEGTFTSDLSKQLEKEAVRLFIEWLKNGGPSSGAPPP S-(NH$_2$) | SEQ ID NO: 1013 |
| B14 | HGEGTFTSDLSKQFEKEAVRLFIEWLKNGGPSSGAPPP S-(NH$_2$) | SEQ ID NO: 1014 |
| B15 | HGEGTFTSDLSKQYEKEAVRLFIEWLKNGGPSSGAPPP S-(NH$_2$) | SEQ ID NO: 1015 |
| B16 | HGEGTFTSDLSKQQEKEAVRLFIEWLKNGGPSSGAPPP S-(NH$_2$) | SEQ ID NO: 1016 |
| B17 | HGEGTFTSDLSKYMEKEAVRLFIEWLKNGGPSSGAPP PS-(NH$_2$) | SEQ ID NO: 1017 |
| B18 | HGEGTFTSDLSKEMEKEAVRLFIEWLKNGGPSSGAPP PS-(NH$_2$) | SEQ ID NO: 1018 |
| B19 | HGEGTFTSDLSKKMEKEAVRLFIEWLKNGGPSSGAPP PS-(NH$_2$) | SEQ ID NO: 1019 |
| B20 | HGEGTFTSDLSKSMEKEAVRLFIEWLKNGGPSSGAPPP S-(NH$_2$) | SEQ ID NO: 1020 |
| B21 | HAEGTFTSDLSKQMEKEAVRLFIEWLKNGGPSSGAPP PS-(NH$_2$) | SEQ ID NO: 21 |
| B22 | H(Aib)EGTFTSDLSKQMEKEAVRLFIEWLKNGGPSSGA PPPS-(NH$_2$) | SEQ ID NO: 1022 |
| B23 | HA(n-methyl-E)GTFTSDLSKQMEKEAVRLFIEWLKNG GPSSGAPPPS-(NH$_2$) | SEQ ID NO: 1023 |
| B24 | HGEGTFTSDLSKQMEKEAVRLFIEWLKNGGPSSGAPP PS-(NH$_2$) | SEQ ID NO: 1024 |
| B27 | HGEGTFTSDLSKQYEKEAVRLFIAWLKNGGPSSGAPP PS-(NH$_2$) | SEQ ID NO: 1027 |
| B28 | HGEGTFTSDLSKQYEKEAVRLFISWLKNGGPSSGAPPP S-(NH$_2$) | SEQ ID NO: 1028 |
| B29 | HGEGTFTSDLSKQYEKEAVRLFIKWLKNGGPSSGAPP PS-(NH$_2$) | SEQ ID NO: 1029 |
| B30 | HGEGTFTSDLSKQYEKEAVRLFIQWLKNGGPSSGAPP PS-(NH$_2$) | SEQ ID NO: 1030 |
| B31 | HGEGTFTSDLSKQYEKEAVRLFIYWLKNGGPSSGAPP PS-(NH$_2$) | SEQ ID NO: 1031 |
| B32 | HGEGTFTSDLSKQYEKEAVRLFI(Aib)WLKNGGPSSGA PPPS-(NH$_2$) | SEQ ID NO: 1032 |
| B33 | HGEGTFTSDLSKQMEKEAVRLFIEWLKNGGPSSGAPP PS-(NH$_2$) | SEQ ID NO: 1033 |
| B39 | HGEGTFTSDLSKQYEKEAVREFIEWLKNGGPSSGAPPP S-(NH$_2$) | SEQ ID NO: 1039 |
| B40 | HGEGTFTSDLSKQYEKEAVRYFIEWLKNGGPSSGAPP PS-(NH$_2$) | SEQ ID NO: 1040 |
| B41 | HGEGTFTSDLSKQYEKEAVRQFIEWLKNGGPSSGAPP PS-(NH$_2$) | SEQ ID NO: 1041 |

TABLE 6-continued

Exemplary compounds: GLP-1 receptor agonist polypeptides optionally comprising a lipophilic substituent, optionally via a spacer; and optionally further comprising a bridging moiety.

| Compound No. | Sequence | SEQ ID NO: |
|---|---|---|
| B42 | HGEGTFTSDLSKQYEKEAVRKFIEWLKNGGPSSGAPPPS-(NH$_2$) | SEQ ID NO: 1042 |
| B43 | HGEGTFTSDLSKQYEKEAVR(Aib)FIEWLKNGGPSSGAPPPS-(NH$_2$) | SEQ ID NO: 1043 |
| B44 | HGEGTFTSDLSKQYEKEAVRHFIEWLKNGGPSSGAPPPS-(NH$_2$) | SEQ ID NO: 1044 |
| B45 | H(Aib)EGTFTSDLSKQYEKEAVRLFISWLKNGGPSSGAPPPS-(NH$_2$) | SEQ ID NO: 1045 |
| B46 | H(Aib)EGTFTSDLSKQYEKEAVRLFIEWLKNGGPSSGAPPPS-(NH$_2$) | SEQ ID NO: 1046 |
| B47 | HGEGTFTSELSKQYEKEAVRLFIEWLKNGGPSSGAPPPS-(NH$_2$) | SEQ ID NO: 1047 |
| B48 | HGEGTFTSDLSKQYEKEAAKLFISWLKNGGPSSGAPPPS-(NH$_2$) | SEQ ID NO: 1048 |
| B49 | HGEGTFTSDLSKQYEKEAARLFISWLKNGGPSSGAPPPS-(NH$_2$) | SEQ ID NO: 1049 |
| B50 | HGEGTFTSDLSKQYEKEAVRLFISWLKNGGP(Dap)SGAPPPS-(NH$_2$) | SEQ ID NO: 1050 |
| B51 | HGEGTFTSDLSKQYEKEAVRLFISWLKNGGPKSGAPPPS-(NH$_2$) | SEQ ID NO: 1051 |
| B52 | HGEGTFTSDLSKQYEKEAVRLFISWLKNGGPHSGAPPPS-(NH$_2$) | SEQ ID NO: 1052 |
| B53 | HGEGTFTSDLSKQYEKEAVRLFISWLKNGGPRSGAPPPS-(NH$_2$) | SEQ ID NO: 1053 |
| B54 | H(Aib)EGTFTSDLSKQYEKEAVREFIEWLKNGGPSSGAPPPS-(NH$_2$) | SEQ ID NO: 1054 |
| B55 | H(Aib)EGTFTSDLSKQYEKEAVRQFIEWLKNGGPSSGAPPPS-(NH$_2$) | SEQ ID NO: 1055 |
| B56 | H(Aib)EGTFTSDLSKQYEKEAARLFIEWLKNGGPSSGAPPPS-(NH$_2$) | SEQ ID NO: 1056 |
| B57 | H(Aib)EGTFTSDLSKQYEKEAARLFIEWLKNGGPHSGAPPPS-(NH$_2$) | SEQ ID NO: 1057 |
| B58 | H(Aib)EGTFTSDLSKQYEKEAVRLFIEWLKDGGPSSGAPPPS-(NH$_2$) | SEQ ID NO: 1058 |
| B59 | H(Aib)EGTFTSDLSKQYEKEAVRLFIEWLKKGGPSSGAPPPS-(NH$_2$) | SEQ ID NO: 1059 |
| B60 | H(Aib)EGTFTSDLSKQYEKEAVRLFIEWLKSGGPSSGAPPPS-(NH$_2$) | $_2$SEQ ID NO: 1060 |
| B61 | H(Aib)EGTFTSDLSKQYEKEAAREFISWLKNGGPHSGAPPPS-(NH$_2$) | SEQ ID NO: 1061 |
| B62 | H(Aib)EGTFTSDLSKQYEKEAARKFISWLKNGGPHSGAPPPS-(NH$_2$) | SEQ ID NO: 1062 |
| B63 | H(Aib)EGTFTSDLSKQYEKEAARKFIEWLKNGGPHSGAPPPS-(NH$_2$) | SEQ ID NO: 1063 |
| B64 | H(Aib)EGTFTSDLSKQYEKEAARQFISWLKNGGPHSGAPPPS-(NH$_2$) | SEQ ID NO: 1064 |
| B65 | H(Aib)EGTFTSDLSKQYEKEAAREFIEWLKNGGPKSGAPPPS-(NH$_2$) | SEQ ID NO: 1065 |

TABLE 6-continued

Exemplary compounds: GLP-1 receptor agonist polypeptides optionally comprising a lipophilic substituent, optionally via a spacer; and optionally further comprising a bridging moiety.

| Compound No. | Sequence | SEQ ID NO: |
|---|---|---|
| B66 | H(Aib)EGTFTSDLSKQYEKEAAREFIEWLKNGGP(Dap)SGAPPPS-(NH$_2$) | SEQ ID NO: 1066 |
| B67 | H(Aib)EGTYTSDLSKQYEKEAAREFIEWLKNGGPSSGAPPPS-(NH$_2$) | SEQ ID NO: 1067 |
| B68 | H(Aib)EGTFTSDLSQQYEKEAAREFIEWLKNGGPSSGAPPPS-(NH$_2$) | SEQ ID NO: 1068 |
| B69 | H(Aib)EGTFTSDLSSQYEKEAAREFIEWLKNGGPSSGAPPPS-(NH$_2$) | SEQ ID NO: 1069 |
| B70 | H(Aib)EGTFTSDLSEQYEKEAAREFIEWLKNGGPSSGAPPPS-(NH$_2$) | SEQ ID NO: 1070 |
| B71 | H(Aib)EGTFTSDLSKQYE(Dap)EAAREFIEWLKNGGPSSGAPPPS-(NH$_2$) | SEQ ID NO: 1071 |
| B72 | H(Aib)EGTFTSDLSKQYE(Dab)EAAREFIEWLKNGGPSSGAPPPS-(NH$_2$) | SEQ ID NO: 1072 |
| B73 | H(Aib)EGTFTSDLSKQYE(Orn)EAAREFIEWLKNGGPSSGAPPPS-(NH$_2$) | SEQ ID NO: 1073 |
| B74 | H(Aib)EGTFTSDLSKQYEKKAVRLFISWLKNGGPSSGAPPPS-(NH$_2$) | SEQ ID NO: 1074 |
| B75 | H(Aib)EGTFTSDLSKQYEKEYVRLFISWLKNGGPSSGAPPPS-(NH$_2$) | SEQ ID NO: 1075 |
| B76 | H(Aib)EGTFTSDLSKQYEKEAAREFIEWLKNGGPSSGAPPPS-(NH$_2$) | SEQ ID NO: 1076 |
| B77 | H(Aib)EGTFTSDLSKQYEKEAARKFISWLKNGGPSSGAPPPS-(NH$_2$) | SEQ ID NO: 1077 |
| B78 | H(Aib)EGTFTSDLSKQYEKEAVREFISWLKNGGPSSGAPPPS-(NH$_2$) | SEQ ID NO: 1078 |
| B79 | H(Aib)EGTFTSDVSEQYEKEAAREFIEWLKNGGPSSGAPPPS-(NH$_2$) | SEQ ID NO: 1079 |
| B80 | H(Aib)EGTFTSDISEQYEKEAAREFIEWLKNGGPSSGAPPPS-(NH$_2$) | SEQ ID NO: 1080 |
| B81 | H(Aib)EGTFTNDLSEQYEKEAAREFIEWLKNGGPSSGAPPPS-(NH$_2$) | SEQ ID NO: 1081 |
| B82 | H(Aib)EGTFTNDVSEQYEKEAAREFIEWLKNGGPSSGAPPPS-(NH$_2$) | SEQ ID NO: 1082 |
| B83 | H(Aib)EGTFTNDISEQYEKEAAREFIEWLKNGGPSSGAPPPS-(NH$_2$) | SEQ ID NO: 1083 |
| B84 | H(Aib)EGTFSSDLSEQYEKEAAREFIEWLKNGGPSSGAPPPS-(NH$_2$) | SEQ ID NO: 1084 |
| B85 | H(Aib)EGTFTSDVSKQYEKEAARLFISWLKNGGPSSGAPPPS-(NH$_2$) | SEQ ID NO: 1085 |
| B86 | H(Aib)EGTFTSDISKQYEKEAARLFISWLKNGGPSSGAPPPS-(NH$_2$) | SEQ ID NO: 1086 |
| B87 | H(Aib)EGTFTNDLSKQYEKEAARLFISWLKNGGPSSGAPPPS-(NH$_2$) | SEQ ID NO: 1087 |
| B88 | H(Aib)EGTFTNDVSKQYEKEAARLFISWLKNGGPSSGAPPPS-(NH$_2$) | SEQ ID NO: 1088 |
| B89 | H(Aib)EGTFTNDISKQYEKEAARLFISWLKNGGPSSGAPPPS-(NH$_2$) | SEQ ID NO: 1089 |

TABLE 6-continued

Exemplary compounds: GLP-1 receptor agonist polypeptides optionally comprising a lipophilic substituent, optionally via a spacer; and optionally further comprising a bridging moiety.

| Compound No. | Sequence | SEQ ID NO: |
| --- | --- | --- |
| B90 | H(Aib)EGTFTSDLSKQYEKKAVREFISWLKNGGPSSGAPPPS-(NH2) | SEQ ID NO: 1090 |
| B91 | H(Aib)EGTFTSDLSKQYEKKAARLFISWLKNGGPSSGAPPPS-(NH2) | SEQ ID NO: 1091 |
| B92 | H(Aib)EGTFTSDLSKQYEKKYVRLFISWLKNGGPSSGAPPPS-(NH2) | SEQ ID NO: 1092 |
| B93 | H(Aib)EGTFTSDLSKQYEKKYARLFISWLKNGGPSSGAPPPS-(NH2) | SEQ ID NO: 1093 |
| B94 | H(Aib)EGTFTSDLSKQYEKKYAREFISWLKNGGPSSGAPPPS-(NH2) | SEQ ID NO: 1094 |
| B95 | H(Aib)EGTFTSDLSKQYEKKYAEEFISWLKNGGPSSGAPPPS-(NH2) | SEQ ID NO: 1095 |
| B96 | H(Aib)EGTFTSDLSKQYEKEAVRQFISWLKNGGPSSGAPPPS-(NH2) | SEQ ID NO: 1096 |
| B97 | H(Aib)EGTFTSDLSKQYEKEYAREFISWLKNGGPSSGAPPPS-(NH2) | SEQ ID NO: 1097 |
| B98 | H(Aib)EGTFTSDLSKQYEKKAAREFISWLKNGGPSSGAPPPS-(NH2) | SEQ ID NO: 1098 |
| B99 | H(Aib)EGTFTSDLSKQYEKKSAREFISWLKNGGPSSGAPPPS-(NH2) | SEQ ID NO: 1099 |
| B100 | H(Aib)EGTFTSDLSKQYEKQAAREFISWLKNGGPSSGAPPPS-(NH2) | SEQ ID NO: 1100 |
| B101 | H(Aib)EGTFTSDLSKQYEKQYAREFISWLKNGGPSSGAPPPS-(NH2) | SEQ ID NO: 1101 |
| B102 | H(Aib)EGTFTSDLSKQYEKQSAREFISWLKNGGPSSGAPPPS-(NH2) | SEQ ID NO: 1102 |
| B103 | H(Aib)EGTFTNDVSKQYEKEAAREFISWLKNGGPSSGAPPPS-(NH2) | SEQ ID NO: 1103 |
| B104 | H(Aib)EGTFTNDVSKQYEKEAVREFISWLKNGGPSSGAPPPS-(NH2) | SEQ ID NO: 1104 |
| B105 | H(Aib)EGTFTSDISKQYEKEAVRQFIEWLKNGGPSSGAPPPS-(NH2) | SEQ ID NO: 1105 |
| B106 | H(Aib)EGTFTSDISKQYEKEAARQFIEWLKNGGPSSGAPPPS-(NH2) | SEQ ID NO: 1106 |
| B107 | H(Aib)EGTFTNDISKQYEKEAAREFISWLKNGGPSSGAPPPS-(NH2) | SEQ ID NO: 1107 |
| B108 | H(Aib)EGTFTNDISKQYEKEAVREFISWLKNGGPSSGAPPPS-(NH2) | SEQ ID NO: 1108 |
| B109 | H(Aib)EGTFTNDISKQYEKEAVRQFIEWLKNGGPSSGAPPPS-(NH2) | SEQ ID NO: 1109 |
| B110 | H(Aib)EGTFTNDISKQYEKEAARQFIEWLKNGGPSSGAPPPS-(NH2) | SEQ ID NO: 1110 |
| B111 | H(Aib)EGTFTSDISKQYEKEAARKFISWLKNGGPSSGAPPPS-(NH2) | SEQ ID NO: 1111 |
| B112 | H(Aib)EGTFTNDISKQYEKEAARKFISWLKNGGPSSGAPPPS-(NH2) | SEQ ID NO: 1112 |
| B113 | H(Aib)EGTFTNDLSKQYEKEAARKFISWLKNGGPSSGAPPPS-(NH2) | SEQ ID NO: 1113 |

TABLE 6-continued

Exemplary compounds: GLP-1 receptor agonist polypeptides optionally comprising a lipophilic substituent, optionally via a spacer; and optionally further comprising a bridging moiety.

| Compound No. | Sequence | SEQ ID NO: |
|---|---|---|
| B114 | H(Aib)EGTFTNDVSKQYEKEAARKFISWLKNGGPSSG APPPS-(NH$_2$) | SEQ ID NO: 1114 |
| B115 | H(Aib)EGTFTSDVSKQYEKEAARKFISWLKNGGPSSGA PPPS-(NH$_2$) | SEQ ID NO: 1115 |
| B116 | H(Aib)EGTFTNDISKQYEKEYAREFISWLKNGGPSSGA PPPS-(NH$_2$) | SEQ ID NO: 1116 |
| B119 | H(Aib)EGTFTSDLSKQYEKEAAREFISWLKKGGPSSGA PPPS-(NH$_2$) | SEQ ID NO: 1119 |
| B120 | H(Aib)EGTFTSDLSKQYEKEAAKKFIEWLKNGGPSSGA PPPS-(NH$_2$) | SEQ ID NO: 1120 |
| B121 | H(Aib)EGTFTSDLSKQYEKEAAEEFIKWLKNGGPSSGA PPPS-(NH$_2$) | SEQ ID NO: 1121 |
| B122 | H(Aib)EGTFTSDLSKQMEEEAVRKFISWLKNGGPSSGA PPPS-(NH$_2$) | SEQ ID NO: 1122 |
| B123 | H(Aib)EGTFTSDLSKQYEEEAVKEFISWLKNGGPSSGA PPPS-(NH$_2$) | SEQ ID NO: 1123 |
| B124 | H(Aib)EGTFTSDLSKQMEEEAVKEFISWLKNGGPSSGA PPPS-(NH$_2$) | SEQ ID NO: 1124 |
| B125 | H(Aib)EGTFTSDLSKQMEEEAKREFISWLKNGGPSSGA PPPS-(NH$_2$) | SEQ ID NO: 1125 |
| B127 | H(Aib)EGTFTSDLSKQYEEEAAKKFISWLKNGGPSSGA PPPS-(NH$_2$) | SEQ ID NO: 1127 |
| B128 | H(Aib)EGTFTSDLSKQYEEKYAKEFISWLKNGGPSSGA PPPS-(NH$_2$) | SEQ ID NO: 1128 |
| B129 | H(Aib)EGTFTSDLSKQYEEKYKKEFISWLKNGGPSSGA PPPS-(NH$_2$) | SEQ ID NO: 1129 |
| B130 | H(Aib)EGTFTSDLSKQYEEEAVKEFISWLKQGGPSSGA PPPS-(NH$_2$) | SEQ ID NO: 1130 |
| B131 | H(Aib)EGTFTSDLSKQYEEEAAKKFISWLKQGGPSSGA PPPS-(NH$_2$) | SEQ ID NO: 1131 |
| B132 | H(Aib)EGTFTSDVSKQYEKEAVRKFISWLKNGGPSSGA PPPS-(NH$_2$) | SEQ ID NO: 1132 |
| B133 | H(Aib)EGTFTSDISKQYEKEAVREFISWLKNGGPSSGAP PPS-(NH$_2$) | SEQ ID NO: 1133 |
| B134 | H(Aib)EGTFTSDISKQYEKEAVRKFISWLKNGGPSSGA PPPS-(NH$_2$) | SEQ ID NO: 1134 |
| B135 | H(Aib)EGTFTSDVSKQYEKEAVKKFIEWLKNGGPSSG APPPS-(NH$_2$) | SEQ ID NO: 1135 |
| B136 | H(Aib)EGTFTSDISKQYEKEAVKEFIEWLKNGGPSSGA PPPS-(NH$_2$) | SEQ ID NO: 1136 |
| B137 | H(Aib)EGTFTSDVSKQYEKEAAKKFIEWLKNGGPSSG APPPS-(NH$_2$) | SEQ ID NO: 1137 |
| B138 | H(Aib)EGTFTSDVSKQYEKEAAKKFIEWLKQGGPSSG APPPS-(NH$_2$) | SEQ ID NO: 1138 |
| B139 | H(Aib)EGTFTSDVSKQYEKEAARKFISWLKQGGPSSGA PPPS-(NH$_2$) | SEQ ID NO: 1139 |
| B140 | H(Aib)EGTFTSDVSKQYEKEAVKKFIEWLKQGGPSSG APPPS-(NH$_2$) | SEQ ID NO: 1140 |

TABLE 6-continued

Exemplary compounds: GLP-1 receptor agonist polypeptides optionally comprising a lipophilic substituent, optionally via a spacer; and optionally further comprising a bridging moiety.

| Compound No. | Sequence | SEQ ID NO: |
|---|---|---|
| B141 | H(Aib)EGTFTSDVSKQYEKKAAREFISWLKNGGPSSGAPPPS-(NH$_2$) | SEQ ID NO: 1141 |
| B142 | H(Aib)EGTFTSDLSKQYEKEAVRKFIEWLKNGGPSSGAPPPS-(NH$_2$) | SEQ ID NO: 1142 |
| B145 | H(Aib)EGTFTSDLSKQYEKEAVRLFIEWLKNGGPHSGAPPPS-(NH$_2$) | SEQ ID NO: 1145 |
| B148 | H(Aib)EGTFTSDLSKQYEKEAARKFIEWLKNGGPSSGAPPPS-(NH$_2$) | SEQ ID NO: 1148 |
| B151 | H(Aib)EGTFTSDLSKQYEKEAVRKFIEWLKNGGPHSGAPPPS-(NH$_2$) | SEQ ID NO: 1151 |
| B152 | H(Aib)EGTFTSDLSKQYEKEAVREFIEWLKNGGPHSGAPPPS-(NH$_2$) | SEQ ID NO: 1152 |
| B153 | H(Aib)EGTFTSDLSKQYEKEAVRQFIEWLKNGGPHSGAPPPS-(NH$_2$) | SEQ ID NO: 1153 |
| B154 | H(Aib)EGTFTSDLSKQYEKEAAREFIEWLKNGGPHSGAPPPS-(NH$_2$) | SEQ ID NO: 1154 |
| B155 | H(Aib)EGTFTSDLSKQYEKEAARQFIEWLKNGGPHSGAPPPS-(NH$_2$) | SEQ ID NO: 1155 |
| B156 | H(Aib)EGTFTSDLSKQYEKEAVRLFISWLKNGGPHSGAPPPS-(NH$_2$) | SEQ ID NO: 1156 |
| B157 | H(Aib)EGTFTSDLSKQYEKEAAREFISWLKNGGPSSGAPPPS-(NH$_2$) | SEQ ID NO: 1157 |
| B158 | H(Aib)EGTFTSDLSKQYEKEAVRKFISWLKNGGPSSGAPPPS-(NH$_2$) | SEQ ID NO: 1158 |
| B159 | H(Aib)EGTFTSDLSEQYE(Dap)EAAREFIEWLKNGGPSSGAPPPS-(NH$_2$) | SEQ ID NO: 1159 |
| B160 | H(Aib)EGTFTSDLSEQYE(Dap)EAARLFIEWLKNGGPSSGAPPPS-(NH$_2$) | SEQ ID NO: 1160 |
| B161 | H(Aib)EGTFTSDLSEQYEKEAARLFIEWLKNGGPSSGAPPPS-(NH$_2$) | SEQ ID NO: 1161 |
| B162 | H(Aib)EGTFTEDLSKQYEKEAVRLFISWLKNGGPSSGAPPPS-(NH$_2$) | SEQ ID NO: 1162 |

In some embodiments, the isolated polypeptide comprises an amino acid sequence selected from the group consisting of SEQ ID NOs: 1000 to 1162. or a pharmaceutically acceptable salt thereof.

In some embodiments, the isolated polypeptide comprises an amino acid sequence selected form the group consisting of SEQ ID NOS: 1006, 1045, 1046, 1054, 1055, 1062, 1068, 1070, 1071, 1074, 1075, 1077, 1078, 1085, 1086, 1087, 1088, 1089, 1092, 1094, 1103, 1107, 1108, 1111, 1112, 1114, 1115, 1120, 1132, 1134, 1139, 1147, and 1149.

In some embodiments, the isolated polypeptide comprises an amino acid sequence selected from the group consisting of SEQ ID NOs: 1006, 1045, 1046, 1054, 1055, 1077, 1078, 1108, 1111, 1112, 1114, 1115, 1120, 1132, 1134, and 1139 or a pharmaceutically acceptable salt thereof.

In some embodiments, the isolated polypeptide comprises an amino acid sequence selected from the group consisting of SEQ ID NOs: 1055, 1115, 1120 and 1132 or a pharmaceutically acceptable salt thereof.

In some embodiments, the isolated polypeptide comprises an amino acid sequence of SEQ ID NO: 1055 or a pharmaceutically acceptable salt thereof. In some embodiments, the isolated polypeptide comprises an amino acid sequence of SEQ ID NO: 1115 or a pharmaceutically acceptable salt thereof. In some embodiments, the isolated polypeptide comprises an amino acid sequence of SEQ ID NO: 1120 or a pharmaceutically acceptable salt thereof. In some embodiments, the isolated polypeptide comprises an amino acid sequence of SEQ ID NO: 1132 or a pharmaceutically acceptable salt thereof.

In some embodiments, the present invention provides a compound set forth in the Table 6, above, or a pharmaceutically acceptable salt thereof. In some embodiments, the present invention provides an isolated polypeptide that comprises an amino acid sequence selected from the group consisting of SEQ ID NOs: 1000 to 1162 or a pharmaceutically acceptable salt thereof. In some embodiments the pharmaceutically acceptable salt is an acetate salt. In some embodiments the pharmaceutically acceptable salt is a trifluoroacetic acid (TFA) salt. In some embodiments the pharmaceutically acceptable salt is a hydrochloric acid (HCl) salt.

In one embodiment, the compound is the isolated polypeptide comprising an amino acid sequence of SEQ ID NO:

lated polypeptide comprising an amino acid sequence of SEQ ID NO: 1132. In some embodiments, the compound is the TFA salt of the isolated polypeptide comprising an amino acid sequence of SEQ ID NO: 1132. In some embodiments, the compound is the HCl salt of the isolated polypeptide comprising an amino acid sequence of SEQ ID NO: 1132.

TABLE 7

Exemplary compounds: GLP-1 receptor agonist polypeptides optionally covalently bound to a lipophilic substituent, optionally via a spacer

| Compound No. | Sequence | SEQ ID NO: |
|---|---|---|
| C117 | H(Aib)EGTFTSDLSKQYEKE⁺AARK⁺FISWLKNGGPSSGAPPPS-(NH$_2$) | SEQ ID NO: 2117 |
| C118 | H(Aib)EGTFTSDLSKQYEKK⁺AARE⁺FISWLKNGGPSSGAPPPS-(NH$_2$) | SEQ ID NO: 2118 |
| C119 | H(Aib)EGTFTSDLSKQYEKEAARE⁺FISWLKK⁺GGPSSGAPPPS-(NH$_2$) | SEQ ID NO: 2119 |
| C120 | H(Aib)EGTFTSDLSKQYEKEAAK⁺KFIE⁺WLKNGGPSSGAPPPS-(NH$_2$) | SEQ ID NO: 2120 |
| C121 | H(Aib)EGTFTSDLSKQYEKEAAE⁺EFIK⁺WLKNGGPSSGAPPPS-(NH$_2$) | SEQ ID NO: 2121 |
| C135 | H(Aib)EGTFTSDVSKQYEKEAVK⁺KFIE⁺WLKNGGPSSGAPPPS-(NH$_2$) | SEQ ID NO: 2135 |
| C136 | H(Aib)EGTFTSDISKQYEKEAVK⁺EFIE⁺WLKNGGPSSGAPPPS-(NH$_2$) | SEQ ID NO: 2136 |
| C137 | H(Aib)EGTFTSDVSKQYEKEAAK⁺KFIE⁺WLKNGGPSSGAPPPS-(NH$_2$) | SEQ ID NO: 2137 |
| C138 | H(Aib)EGTFTSDVSKQYEKEAAK⁺KFIE⁺WLKQGGPSSGAPPPS-(NH$_2$) | SEQ ID NO: 2138 |
| C140 | H(Aib)EGTFTSDVSKQYEKEAVK⁺KFIE⁺WLKQGGPSSGAPPPS-(NH$_2$) | SEQ ID NO: 2140 |
| C141 | H(Aib)EGTFTSDVSKQYEKK⁺AARE⁺FISWLKNGGPSSGAPPPS-(NH$_2$) | SEQ ID NO: 2141 |

Note:
Each pairing of K⁺ and E⁺ represents a covalent amide linkage derived from the amino sidechain of K⁺ and the carboxy sidechain of E⁺ (with loss of a water molecule).

1055 or a pharmaceutically acceptable salt thereof. In some embodiments, the compound is the acetate salt of the isolated polypeptide comprising an amino acid sequence of SEQ ID NO: 1055. In some embodiments, the compound is the TFA salt of the isolated polypeptide comprising an amino acid sequence of SEQ ID NO: 1055. In some embodiments, the compound is the HCl salt of the isolated polypeptide comprising an amino acid sequence of SEQ ID NO: 1055.

In one embodiment, the compound is the isolated polypeptide comprising an amino acid sequence of SEQ ID NO: 1115 or a pharmaceutically acceptable salt thereof. In some embodiments, the compound is the acetate salt of the isolated polypeptide comprising an amino acid sequence of SEQ ID NO: 1115. In some embodiments, the compound is the TFA salt of the isolated polypeptide comprising an amino acid sequence of SEQ ID NO: 1115. In some embodiments, the compound is the HCl salt of the isolated polypeptide comprising an amino acid sequence of SEQ ID NO: 1115.

In one embodiment, the compound is the isolated polypeptide comprising an amino acid sequence of SEQ ID NO: 1120 or a pharmaceutically acceptable salt thereof. In some embodiments, the compound is the acetate salt of the isolated polypeptide comprising an amino acid sequence of SEQ ID NO: 1120. In some embodiments, the compound is the TFA salt of the isolated polypeptide comprising an amino acid sequence of SEQ ID NO: 1120. In some embodiments, the compound is the HCl salt of the isolated polypeptide comprising an amino acid sequence of SEQ ID NO: 1120.

In one embodiment, the compound is the isolated polypeptide comprising an amino acid sequence of SEQ ID NO: 1132 or a pharmaceutically acceptable salt thereof. In some embodiments, the compound is the acetate salt of the iso- In some embodiments, the isolated polypeptide comprises an amino acid sequence selected from the group consisting of SEQ ID NOs: 2117, 2118, 2119, 2120, 2121, 2135, 2136, 2137, 2138, 2140 and 2141 or a pharmaceutically acceptable salt thereof.

In some embodiments, the isolated polypeptide comprises an amino acid sequence of SEQ ID NO: 2117 or a pharmaceutically acceptable salt thereof. In some embodiments, the isolated polypeptide comprises an amino acid sequence of SEQ ID NO: 2118 or a pharmaceutically acceptable salt thereof. In some embodiments, the isolated polypeptide comprises an amino acid sequence of SEQ ID NO: 2119 or a pharmaceutically acceptable salt thereof. In some embodiments, the isolated polypeptide comprises an amino acid sequence of SEQ ID NO: 2120 or a pharmaceutically acceptable salt thereof. In some embodiments, the isolated polypeptide comprises an amino acid sequence of SEQ ID NO: 2121 or a pharmaceutically acceptable salt thereof. In some embodiments, the isolated polypeptide comprises an amino acid sequence of SEQ ID NO: 2135 or a pharmaceutically acceptable salt thereof. In some embodiments, the isolated polypeptide comprises an amino acid sequence of SEQ ID NO: 2136 or a pharmaceutically acceptable salt thereof. In some embodiments, the isolated polypeptide comprises an amino acid sequence of SEQ ID NO: 2137 or a pharmaceutically acceptable salt thereof. In some embodiments, the isolated polypeptide comprises an amino acid sequence of SEQ ID NO: 2138 or a pharmaceutically acceptable salt thereof. In some embodiments, the isolated polypeptide comprises an amino acid sequence of SEQ ID NO: 2140 or a pharmaceutically acceptable salt thereof. In some embodiments, the isolated polypeptide comprises an amino acid sequence of SEQ ID NO: 2141 or a pharmaceutically acceptable salt thereof.

In some embodiments the pharmaceutically acceptable salt is an acetate salt. In some embodiments the pharmaceutically acceptable salt is a trifluoroacetic acid (TFA) salt. In some embodiments the pharmaceutically acceptable salt is a hydrochloric acid (HCl) salt.

Polypeptide Intermediates & General Methods of Providing the Present Compounds

The compounds of this invention may be prepared or isolated in general by synthetic and/or semi-synthetic methods known to those skilled in the art for analogous compounds and by methods described in detail in the Examples, herein.

In the Schemes below, where a particular protecting group ("PG"), leaving group ("LG"), or transformation condition is depicted, one of ordinary skill in the art will appreciate that other protecting groups, leaving groups, and transformation conditions are also suitable and are contemplated. Such groups and transformations are described in detail in *March's Advanced Organic Chemistry: Reactions, Mechanisms, and Structure*, M. B. Smith and J. March, 5$^{th}$ Edition, John Wiley & Sons, 2001, *Comprehensive Organic Transformations*, R. C. Larock, 2$^{nd}$ Edition, John Wiley & Sons, 1999, and *Protecting Groups in Organic Synthesis*, T. W. Greene and P. G. M. Wuts, 3$^{rd}$ edition, John Wiley & Sons, 1999, the entirety of each of which is hereby incorporated herein by reference.

As used herein, the phrase "leaving group" (LG) includes, but is not limited to, halogens (e.g. fluoride, chloride, bromide, iodide), sulfonates (e.g. mesylate, tosylate, benzenesulfonate, brosylate, nosylate, triflate), diazonium, and the like.

As used herein, the phrase "oxygen protecting group" includes, for example, carbonyl protecting groups, hydroxyl protecting groups, etc. Hydroxyl protecting groups are well known in the art and include those described in detail in *Protecting Groups in Organic Synthesis*, T. W. Greene and P. G. M. Wuts, 3$^{rd}$ edition, John Wiley & Sons, 1999, the entirety of which is incorporated herein by reference. Examples of suitable hydroxyl protecting groups include, but are not limited to, esters (e.g., acetyl, benzyl), allyl ethers, ethers, silyl ethers, alkyl ethers, arylalkyl ethers, benzyl ethers and alkoxyalkyl ethers. Examples of such esters include formates, acetates, carbonates, and sulfonates. Specific examples include formate, benzoyl formate, chloroacetate, trifluoroacetate, methoxyacetate, triphenylmethoxyacetate, p-chlorophenoxyacetate, 3-phenylpropionate, 4-oxopentanoate, 4,4-(ethylenedithio)pentanoate, pivaloate (trimethylacetyl), crotonate, 4-methoxy-crotonate, benzoate, p-benylbenzoate, 2,4,6-trimethylbenzoate, carbonates such as methyl, 9-fluorenylmethyl, ethyl, 2,2,2-trichloroethyl, 2-(trimethylsilyl)ethyl, 2-(phenylsulfonyl)ethyl, vinyl, allyl, and p-nitrobenzyl. Examples of such silyl ethers include trimethylsilyl, triethylsilyl, t-butyldimethylsilyl, t-butyldiphenylsilyl, triisopropylsilyl, and other trialkylsilyl ethers. Alkyl ethers include methyl, benzyl, p-methoxybenzyl, 3,4-dimethoxybenzyl, trityl, t-butyl, allyl, and allyloxycarbonyl ethers or derivatives. Alkoxyalkyl ethers include acetals such as methoxymethyl, methylthiomethyl, (2-methoxyethoxy)methyl, benzyloxymethyl, beta-(trimethylsilyl)ethoxymethyl, and tetrahydropyranyl ethers. Examples of arylalkyl ethers include benzyl, p-methoxybenzyl (MPM), 3,4-dimethoxybenzyl, O-nitrobenzyl, p-nitrobenzyl, p-halobenzyl, 2,6-dichlorobenzyl, p-cyanobenzyl, and 2- and 4-picolyl.

Amino protecting groups are well known in the art and include those described in detail in *Protecting Groups in Organic Synthesis*, T. W. Greene and P. G. M. Wuts, 3$^{rd}$ edition, John Wiley & Sons, 1999, the entirety of which is incorporated herein by reference. Suitable amino protecting groups include, but are not limited to, aralkylamines, carbamates, cyclic imides, allyl amines, amides, and the like. Examples of such groups include t-butyloxycarbonyl (Boc), ethyloxycarbonyl, methyloxycarbonyl, trichloroethyloxycarbonyl, allyloxycarbonyl (Alloc), benzyloxocarbonyl (Cbz), allyl, phthalimide, benzyl (Bn), dimethyl-2,6-dioxocyclohex-1-ylidene)ethyl (Dmb), 1-(4,4-dimethyl-2,6-dioxocyclohex-1-ylidene)-3-methylbutyl (ivDde), fluorenylmethylcarbonyl (Fmoc), formyl, acetyl, chloroacetyl, dichloroacetyl, trichloroacetyl, phenylacetyl, trifluoroacetyl, benzoyl, and the like.

In certain embodiments, the present invention also relates to synthetic peptide intermediates of disclosed GLP-1 receptor agonists. In some embodiments, a polypeptide intermediate of the disclosure is an isolated polypeptide comprising the amino acid sequence of SEQ ID NO: 400: HX$_2$X$_3$GTX$_6$X$_7$X$_8$X$_9$X$_{10}$SX$_{12}$X$_{13}$X$_{14}$EX$_{16}$X$_{17}$X$_{18}$X$_{19}$X$_{20}$X$_{21}$FIX$_{24}$WLKX$_{28}$GGPX$_{32}$SGAPPPS-(OH/NH$_2$) (SEQ ID NO: 400) or a pharmaceutically acceptable salt thereof, wherein:

X$_2$ is A, 2-aminoisobutyric acid (Aib), or G;
X$_3$ is E or N-methyl Glu;
X$_6$ is F or Y;
X$_7$ is S or T;
X$_8$ is diaminopimelic acid (Dap), E, K, N, N-methyl Ser, Q, S, s, or Y;
X$_9$ is D or E;
X$_{10}$ is I, L, N-methyl Leu, or V;
X$_{12}$ is E, K, Q, or S;
X$_{13}$ is Aib, E, K, Q, S, W, or Y;
X$_{14}$ is E, R, I, K, L, M, Q, or Y;
X$_{16}$ is 2,4-diaminobutanoic acid (Dab), Dap, E, K, k, or ornithine (Orn);
X$_{17}$ is E, K, or Q;
X$_{18}$ is A, K, S, or Y;
X$_{19}$ is A, K, or V;
X$_{20}$ is E, K, or R;
X$_{21}$ is Aib, E, H, K, L, Q, or Y;
X$_{24}$ is A, Aib, E, K, Q, S, or Y;
X$_{28}$ is D, E, K, N, Q, S, or Y; and
X$_{32}$ is Dap, H, K, R, or S;
wherein each Dab, Dap, K or Orn independently represents Dab, Dap, K or Orn optionally covalently bound to a protecting group or a spacer optionally bound to a protecting group.

In some embodiments, the spacer is not bound to a protecting group.

In one embodiment, the synthetic peptide intermediate is not a precursor of exenatide, HGEGTFTSDLSKQMEEE-AVRLFIEWLKNGGPSSGAPPPS-NH$_2$ (SEQ ID NO: 300), having K$_{12}$ or K$_{27}$ covalently bound to a protecting group or a spacer optionally bound to a protecting group.

In some embodiments, X$_2$ is Aib.
In some embodiments, if X$_{24}$ is S, then X$_{10}$ is V.
In some embodiments, X$_{14}$ is Y.
In some embodiments, X$_{14}$ is M, and X$_{16}$ is K.
In some embodiments, X$_{16}$ is K.
In some embodiments, if X$_{16}$ is E, then X$_{21}$ is K or E. In some embodiments, if X$_{16}$ is E, then X$_{21}$ is K. In some embodiments, if X$_{16}$ is E, then X$_{21}$ is E.
In some embodiments, X$_2$ is A. In some embodiments, X$_2$ is Aib. In some embodiments, X$_2$ is G.

In some embodiments, $X_3$ is E. In some embodiments, $X_3$ is N-methyl Glu.

In some embodiments, $X_6$ is F. In some embodiments, $X_6$ is Y.

In some embodiments, $X_7$ is S. In some embodiments, $X_7$ is T.

In some embodiments, $X_8$ is Dap. In some embodiments, $X_8$ is E. In some embodiments, $X_8$ is K. In some embodiments, $X_8$ is N. In some embodiments, $X_8$ is N-methyl Ser. In some embodiments, $X_8$ is Q. In some embodiments, $X_8$ is S. In some embodiments, $X_8$ is s. In some embodiments, $X_8$ is Y.

In some embodiments, $X_9$ is D. In some embodiments, $X_9$ is E.

In some embodiments, $X_{10}$ is I. In some embodiments, $X_{10}$ is L. In some embodiments, $X_{10}$ is N-methyl Leu. In some embodiments, $X_{10}$ is V.

In some embodiments, $X_{12}$ is E. In some embodiments, $X_{12}$ is K. In some embodiments, $X_{12}$ is Q. In some embodiments, $X_{12}$ is S.

In some embodiments, $X_{13}$ is Aib. In some embodiments, $X_{13}$ is E. In some embodiments, $X_{13}$ is K. In some embodiments, $X_{13}$ is Q. In some embodiments, $X_{13}$ is S. In some embodiments, $X_{13}$ is W. In some embodiments, $X_{13}$ is Y.

In some embodiments, $X_{14}$ is E. In some embodiments, $X_{14}$ is R. In some embodiments, $X_{14}$ is I. In some embodiments, $X_{14}$ is K. In some embodiments, $X_{14}$ is L. In some embodiments, $X_{14}$ is M. In some embodiments, $X_{14}$ is Q. In some embodiments, $X_{14}$ is Y.

In some embodiments, $X_{16}$ is Dab. In some embodiments, $X_{16}$ is Dap. In some embodiments, $X_{16}$ is E. In some embodiments, $X_{16}$ is K. In some embodiments, $X_{16}$ is k. In some embodiments, $X_{16}$ is Orn.

In some embodiments, $X_{17}$ is E. In some embodiments, $X_{17}$ is K. In some embodiments, $X_{17}$ is Q.

In some embodiments, $X_{18}$ is A. In some embodiments, $X_{18}$ is K. In some embodiments, $X_{18}$ is S. In some embodiments, $X_{18}$ is Y.

In some embodiments, $X_{19}$ is A. In some embodiments, $X_{19}$ is K. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is Aib. In some embodiments, $X_{21}$ is E. In some embodiments, $X_{21}$ is H. In some embodiments, $X_{21}$ is K. In some embodiments, $X_{21}$ is L. In some embodiments, $X_{21}$ is Q. In some embodiments, $X_{21}$ is Y.

In some embodiments, $X_{24}$ is A. In some embodiments, $X_{24}$ is Aib. In some embodiments, $X_{24}$ is E. In some embodiments, $X_{24}$ is K. In some embodiments, $X_{24}$ is Q. In some embodiments, $X_{24}$ is S. In some embodiments, $X_{24}$ is Y.

In some embodiments, $X_{28}$ is D. In some embodiments, $X_{28}$ is E. In some embodiments, $X_{28}$ is K. In some embodiments, $X_{28}$ is N. In some embodiments, $X_{28}$ is Q. In some embodiments, $X_{28}$ is S. In some embodiments, $X_{28}$ is Y.

In some embodiments, $X_{32}$ is Dap. In some embodiments, $X_{32}$ is H. In some embodiments, $X_{32}$ is K. In some embodiments, $X_{32}$ is R. In some embodiments, $X_{32}$ is S.

In some embodiments, carboxy terminal amino acid, i.e. $S_{39}$, is $—S_{39}—(NH_2)$. In some embodiments, carboxy terminal amino acid $S_{39}$ is $—S_{39}—(OH)$.

In some embodiments, a polypeptide intermediate of the disclosure is an isolated polypeptide comprising the amino acid sequence of SEQ ID NO: 405:

$HX_2EGTFTX_8DX_{10}SX_{12}QYEKX_{17}X_{18}X_{19}X_{20}X_{21}$
$FIX_{24}WLKX_{28}GGPX_{32}SGAPPPS-(OH/NH_2)$ (SEQ ID NO: 405), or a pharmaceutically acceptable salt thereof, wherein:

$X_2$ is 2-aminoisobutyric acid (Aib) or G;

$X_8$ is N or S;

$X_{10}$ is I, L, or V;

$X_{12}$ is E, K, or Q;

$X_{17}$ is E or K;

$X_{18}$ is A or Y;

$X_{19}$ is A or V;

$X_{20}$ is E, K, or R;

$X_{21}$ is E, K, L, or Q;

$X_{24}$ is E, K, or S;

$X_{28}$ is N or Q; and $X_{32}$ is H or S;

wherein each K represents lysine optionally covalently bound to a protecting group or a spacer optionally bound to a protecting group.

In some embodiments, the spacer is not bound to a protecting group.

In some embodiments, $X_2$ is Aib.

In some embodiments, the lysine residue at the sixteenth position of SEQ ID NO: 405 is covalently bound to a protecting group or a spacer optionally bound to a protecting group.

In some embodiments, if $X_{24}$ is S, then $X_{10}$ is V.

In some embodiments, the peptide further comprises a lactam bridge formed via an amide bond between the side chains of a lysine and a glutamic acid at positions $X_{20}$ and $X_{24}$, respectively.

In some embodiments, $X_2$ is Aib. In some embodiments, $X_2$ is G.

In some embodiments, $X_8$ is N. In some embodiments, $X_8$ is S.

In some embodiments, $X_{10}$ is I. In some embodiments, $X_{10}$ is L. In some embodiments, $X_{10}$ is V.

In some embodiments, $X_{12}$ is E. In some embodiments, $X_{12}$ is K. In some embodiments, $X_{12}$ is Q.

In some embodiments, $X_{17}$ is E. In some embodiments, $X_{17}$ is K.

In some embodiments, $X_{18}$ is A. In some embodiments, $X_{18}$ is Y.

In some embodiments, $X_{19}$ is A. In some embodiments, $X_{19}$ is V.

In some embodiments, $X_{20}$ is E. In some embodiments, $X_{20}$ is K. In some embodiments, $X_{20}$ is R.

In some embodiments, $X_{21}$ is E. In some embodiments, $X_{21}$ is K. In some embodiments, $X_{21}$ is L. In some embodiments, $X_{21}$ is Q.

In some embodiments, $X_{24}$ is E. In some embodiments, $X_{24}$ is K. In some embodiments, $X_{24}$ is S.

In some embodiments, $X_{28}$ is N. In some embodiments, $X_{28}$ is Q.

In some embodiments, $X_{32}$ is H. In some embodiments, $X_{32}$ is S.

In some embodiments, carboxy terminal amino acid, i.e. $S_{39}$, is $—S_{39}—(NH_2)$. In some embodiments, carboxy terminal amino acid $S_{39}$ is $—S_{39}—(OH)$.

Exemplary Polypeptide Intermediates

In some embodiments, an isolated polypeptide of the disclosure comprises an amino acid sequence selected form the group consisting of the following peptides listed in Tables 8 and 9:

TABLE 8

Compound A120 and exemplary polypeptide intermediates thereof.

| Compound No. | Sequence | SEQ ID NO: |
|---|---|---|
| A120 | H(Aib)EGTFTSDLSKQYEK*(γGlu-γGlu-dpeg-CO(CH$_2$)$_{18}$CO$_2$H)EAAK$^+$KFIE$^+$WLKNGGPSSGAPPPS-(NH$_2$) | SEQ ID NO: 120 |
| D3120 | H(Aib)EGTFTSDLSKQYEK*(γGlu-γGlu-dpeg)EAAK$^+$KFIE$^+$WLKNGGPSSGAPPPS-(NH$_2$) | SEQ ID NO: 3120 |
| D4120 | H(Aib)EGTFTSDLSKQYEK*(γGlu-γGlu)EAAK$^+$KFIE$^+$WLKNGGPSSGAPPPS-(NH$_2$) | SEQ ID NO: 4120 |
| D5120 | H(Aib)EGTFTSDLSKQYEK*(γGlu)EAAK$^+$KFIE$^+$WLKNGGPSSGAPPPS-(NH$_2$) | SEQ ID NO: 5120 |
| D6120 | H(Aib)EGTFTSDLSKQYEK*(free amine)EAAK$^+$KFIE$^+$WLKNGGPSSGAPPPS-(NH$_2$) | SEQ ID NO: 6120 |
| D7120 | H(Aib)EGTFTSDLSKQYEK*(ivDde)EAAK$^+$KFIE$^+$WLKNGGPSSGAPPPS-(NH$_2$) | SEQ ID NO: 7120 |
| D8120 | H(Aib)EGTFTSDLSKQYEK*(ivDde)EAAKKFIEWLKNGGPSSGAPPPS-(NH$_2$) | SEQ ID NO: 8120 |
| D9120 | H(Aib)EGTFTSDLSKQYEK*(ivDde)EAAK(Alloc)KFIE(Allyl)WLKNGGPSSGAPPPS-(NH$_2$) | SEQ ID NO: 9120 |

Notes:
Each pairing of K$^+$ and E$^+$ represents a covalent amide linkage derived from the amino sidechain of K$^+$ and the carboxy sidechain of E$^+$ (with loss of a water molecule).
Alloc = allyloxycarbonyl protecting group
Allyl = allyl (CH$_2$=CH-CH$_2$-) protecting group
ivDde = 1-(4,4-dimethyl-2,6-dioxocyclohex-1-ylidene)-3-methylbutyl protecting group In some embodiments, the present invention provides a peptide intermediate of Compound A120 (SEQ ID NO: 120). In some embodiments, the present invention provides a peptide intermediate set forth in the Table 8, above. In some embodiments, the peptide intermediate is a peptide having the amino acid sequence of SEQ ID NO: 3120. In some embodiments, the peptide intermediate is a peptide having the amino acid sequence of SEQ ID NO: 4120. In some embodiments, the peptide intermediate is a peptide having the amino acid sequence of SEQ ID NO: 5120. In some embodiments, the peptide intermediate is a peptide having the amino acid sequence of SEQ ID NO: 6120. In some embodiments, the peptide intermediate is a peptide having the amino acid sequence of SEQ ID NO: 7120. In some embodiments, the peptide intermediate is a peptide having the amino acid sequence of SEQ ID NO: 8120. In some embodiments, the peptide intermediate is a peptide having the amino acid sequence of SEQ ID NO: 9120.

In some embodiments, the present invention provides a method for preparing compounds of the invention, such as Compound A120 (SEQ ID NO: 120), comprising the step of acylating a polypeptide intermediates, such as Compound D3120 (SEQ ID NO: 3120), with the following activated acyl group, (LG)CO(CH$_2$)$_{zz}$CO$_2$H, wherein ZZ is from 14 to 22 and LG is a leaving group, as defined herein, as exemplified below in Scheme 1:

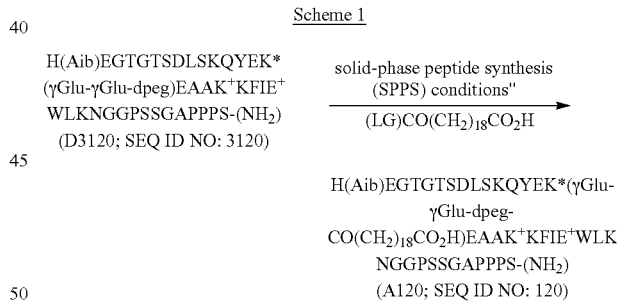

Scheme 1

H(Aib)EGTGTSDLSKQYEK*(γGlu-γGlu-dpeg)EAAK$^+$KFIE$^+$WLKNGGPSSGAPPPS-(NH$_2$) (D3120; SEQ ID NO: 3120)

solid-phase peptide synthesis (SPPS) conditions"
(LG)CO(CH$_2$)$_{18}$CO$_2$H
→

H(Aib)EGTGTSDLSKQYEK*(γGlu-γGlu-dpeg-CO(CH$_2$)$_{18}$CO$_2$H)EAAK$^+$KFIE$^+$WLKNGGPSSGAPPPS-(NH$_2$)
(A120; SEQ ID NO: 120)

TABLE 9

Compound A115 and exemplary polypeptide intermediates thereof.

| Compound No. | Sequence | SEQ ID NO: |
|---|---|---|
| A115 | H(Aib)EGTFTSDVSKQYEK*(γGlu-γGlu-dpeg-CO(CH$_2$)$_{18}$CO$_2$H)EAARKFISWLKNGGPSSGAPPPS-(NH$_2$) | SEQ ID NO: 115 |
| D3115 | H(Aib)EGTFTSDVSKQYEK*(γGlu-γGlu-dpeg)EAARKFISWLKNGGPSSGAPPPS-(NH$_2$) | SEQ ID NO: 3115 |
| D4115 | H(Aib)EGTFTSDVSKQYEK*(γGlu-γGlu)EAARKFISWLKNGGPSSGAPPPS-(NH$_2$) | SEQ ID NO: 4115 |

TABLE 9-continued

Compound A115 and exemplary polypeptide intermediates thereof.

| Compound No. | Sequence | SEQ ID NO: |
|---|---|---|
| D5115 | H(Aib)EGTFTSDVSKQYEK*(γGlu)EAARKFISWLKNGGPSSGAPPPS-(NH$_2$) | SEQ ID NO: 5115 |
| D6115 | H(Aib)EGTFTSDVSKQYEK*(freeamine)EAARKFISWLKNGGPSSGAPPPS-(NH2) | SEQ ID NO: 6115 |
| D7115 | H(Aib)EGTFTSDVSKQYEK*(Alloc)EAARKFISWLKNGGPSSGAPPPS-(NH$_2$) | SEQ ID NO: 7115 |

In some embodiments, the present invention provides a peptide intermediate of Compound A115 (SEQ ID NO: 115). In some embodiments, the present invention provides a peptide intermediate set forth in the Table 9, above. In some embodiments, the peptide intermediate is a peptide having the amino acid sequence of SEQ ID NO: 3115. In some embodiments, the peptide intermediate is a peptide having the amino acid sequence of SEQ ID NO: 4115. In some embodiments, the peptide intermediate is a peptide having the amino acid sequence of SEQ ID NO: 5115. In some embodiments, the peptide intermediate is a peptide having the amino acid sequence of SEQ ID NO: 6115. In some embodiments, the peptide intermediate is a peptide having the amino acid sequence of SEQ ID NO: 7115.

In some embodiments, the present invention provides a method for preparing compounds of the invention, such as Compound A115 (SEQ ID NO: 115), comprising the step of acylating a polypeptide intermediates, such as Compound D3115 (SEQ ID NO: 3115), with the following activated acyl group, (LG)CO(CH$_2$)$_{zz}$CO$_2$H, wherein ZZ is from 14 to 22 and LG is a leaving group, as defined herein, as exemplified below in Scheme 2:

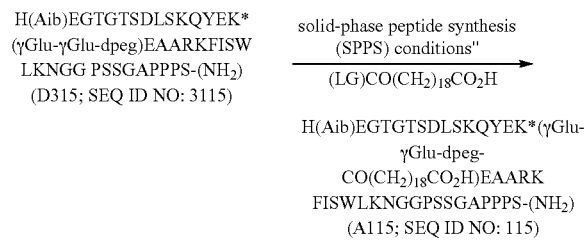

Methods of Use

According to another embodiment, the invention relates to a method of treating metabolic disease or disorder in a subject in need of treatment, comprising providing the subject with an effective amount of an GLP-1 receptor agonist polypeptide of the disclosure or a pharmaceutical composition thereof. Metabolic diseases or disorders include type 1 diabetes, type 2 diabetes, and obesity. Additionally, the invention relates to a method of effecting weight loss in a subject, including a diabetic subject, comprising providing the subject with an effective amount of an GLP-1 receptor agonist polypeptide of the disclosure. In certain embodiments, the invention also relates to methods of treating nonalcoholic fatty liver disease (NAFLD) and/or nonalcoholic steatohepatitis (NASH).

In some embodiments, provided is a method of treating obesity in a human subject, providing weight loss to the human subject, or suppressing appetite in the human subject, comprising administering to the subject any of the polypeptides disclosed herein, a pharmaceutical composition comprising any of the disclosed polypeptides, or an osmotic delivery device comprising any of the disclosed polypeptides.

In some embodiments, provided is a method of treating diabetes in a human subject, comprising administering to the subject any of the polypeptides disclosed herein, a pharmaceutical composition comprising any of the disclosed polypeptides, or an osmotic delivery device comprising any of the disclosed polypeptides. In some embodiments, the diabetes is type 1 diabetes. In some embodiments, the diabetes is type 2 diabetes.

In some embodiments, provided is a method of treating nonalcoholic fatty liver disease (NAFLD) in a human subject, comprising administering to the subject any of the polypeptides disclosed herein, a pharmaceutical composition comprising any of the disclosed polypeptides, or an osmotic delivery device comprising any of the disclosed polypeptides.

In some embodiments, provided is a method of treating nonalcoholic steatohepatitis (NASH) in a human subject, comprising administering to the subject any of the polypeptides disclosed herein, a pharmaceutical composition comprising any of the disclosed polypeptides, or an osmotic delivery device comprising any of the disclosed polypeptides.

GLP-1 receptor agonist polypeptides of the disclosure are particularly useful for the treatment of diabetes, the method comprising providing a diabetic subject with an effective amount of a GLP-1 receptor agonist polypeptide. In some embodiments, a GLP-1 receptor agonist polypeptide of the disclosure is used for the treatment of a subject with type 1 or type 2 diabetes to control, or reduce, concentrations of blood sugar in the subject, where blood sugar levels can be monitored or approximated based on measured blood concentrations of glycated hemoglobin (hemoglobin A1c, HbA1c).

(i) In some embodiments, a GLP-1 receptor agonist polypeptide of the disclosure is used for the treatment of a subject with type 1 diabetes;

(ii) In some embodiments, a GLP-1 receptor agonist polypeptide of the disclosure is used for the treatment of a subject with type 2 diabetes;

(iii) In some embodiments, a GLP-1 receptor agonist polypeptide of the disclosure is used for the treatment of obesity; and (iv) In some embodiments, a GLP-1 receptor agonist polypeptide of the disclosure is used to provide weight loss to a subject, such as a diabetic subject,
(v) In some embodiments, a GLP-1 receptor agonist polypeptide of the disclosure is used for the treatment of nonalcoholic fatty liver disease (NAFLD),
(vi) In some embodiments, a GLP-1 receptor agonist polypeptide of the disclosure is used for the treatment of nonalcoholic steatohepatitis (NASH),
wherein the GLP-1 receptor agonist polypeptide of usage (i), (ii), (iii), (iv), (v) or (vi) comprises any isolated polypeptide of this disclosure including those selected from the group consisting of SEQ ID NOS: 6, 45, 46, 54, 55, 77, 78, 108, 111, 112, 114, 115, 120, 132, 134, and 139 or a pharmaceutically acceptable salt thereof.

In some embodiments, the GLP-1 receptor agonist polypeptide of usage (i), (ii), (iii), (iv), (v) or (vi) comprises any isolated polypeptide of this disclosure including those selected from the group consisting of SEQ ID NOs: 55, 115, 120 and 132 or a pharmaceutically acceptable salt thereof.

In some embodiments, the GLP-1 receptor agonist polypeptide of usage (i), (ii), (iii), (iv), (v) or (vi) comprises the isolated polypeptide of SEQ ID NO: 55 or a pharmaceutically acceptable salt thereof. In some embodiments, the GLP-1 receptor agonist polypeptide of usage (i), (ii), (iii), (iv), (v) or (vi) comprises the isolated polypeptide of SEQ ID NO: 115 or a pharmaceutically acceptable salt thereof. In some embodiments, the GLP-1 receptor agonist polypeptide of usage (i), (ii), (iii), (iv), (v) or (vi) comprises the isolated polypeptide of SEQ ID NO: 120 or a pharmaceutically acceptable salt thereof. In some embodiments, the GLP-1 receptor agonist polypeptide of usage (i), (ii), (iii), (iv), (v) or (vi) comprises the isolated polypeptide of SEQ ID NO: 132 or a pharmaceutically acceptable salt thereof.

In some embodiments, the GLP-1 receptor agonist polypeptide is used for the treatment of a subject with type 1 diabetes wherein the isolated polypeptide is of SEQ ID NO: 55 or a pharmaceutically acceptable salt thereof. In some embodiments, the GLP-1 receptor agonist polypeptide is used for the treatment of a subject with type 1 diabetes wherein the isolated polypeptide is of SEQ ID NO: 115 or a pharmaceutically acceptable salt thereof. In some embodiments, the GLP-1 receptor agonist polypeptide is used for the treatment of a subject with type 1 diabetes wherein the isolated polypeptide is of SEQ ID NO: 120 or a pharmaceutically acceptable salt thereof. In some embodiments, the GLP-1 receptor agonist polypeptide is used for the treatment of a subject with type 1 diabetes wherein the isolated polypeptide is of SEQ ID NO: 132 or a pharmaceutically acceptable salt thereof.

In some embodiments, the GLP-1 receptor agonist polypeptide is used for the treatment of a subject with type 2 diabetes wherein the isolated polypeptide is of SEQ ID NO: 55 or a pharmaceutically acceptable salt thereof. In some embodiments, the GLP-1 receptor agonist polypeptide is used for the treatment of a subject with type 2 diabetes wherein the isolated polypeptide is of SEQ ID NO: 115 or a pharmaceutically acceptable salt thereof. In some embodiments, the GLP-1 receptor agonist polypeptide is used for the treatment of a subject with type 2 diabetes wherein the isolated polypeptide is of SEQ ID NO: 120 or a pharmaceutically acceptable salt thereof. In some embodiments, the GLP-1 receptor agonist polypeptide is used for the treatment of a subject with type 2 diabetes wherein the isolated polypeptide is of SEQ ID NO: 132 or a pharmaceutically acceptable salt thereof.

In some embodiments, the GLP-1 receptor agonist polypeptide is used for the treatment of a subject with obesity wherein the isolated polypeptide is of SEQ ID NO: 55 or a pharmaceutically acceptable salt thereof. In some embodiments, the GLP-1 receptor agonist polypeptide is used for the treatment of a subject with obesity wherein the isolated polypeptide is of SEQ ID NO: 115 or a pharmaceutically acceptable salt thereof. In some embodiments, the GLP-1 receptor agonist polypeptide is used for the treatment of a subject with obesity wherein the isolated polypeptide is of SEQ ID NO: 120 or a pharmaceutically acceptable salt thereof. In some embodiments, the GLP-1 receptor agonist polypeptide is used for the treatment of a subject with obesity wherein the isolated polypeptide is of SEQ ID NO: 132 or a pharmaceutically acceptable salt thereof.

In some embodiments, the GLP-1 receptor agonist polypeptide is used to provide weight loss to a subject wherein the isolated polypeptide is of SEQ ID NO: 55 or a pharmaceutically acceptable salt thereof. In some embodiments, the GLP-1 receptor agonist polypeptide is used to provide weight loss to a subject wherein the isolated polypeptide is of SEQ ID NO: 115 or a pharmaceutically acceptable salt thereof. In some embodiments, the GLP-1 receptor agonist polypeptide is used to provide weight loss to a subject wherein the isolated polypeptide is of SEQ ID NO: 120 or a pharmaceutically acceptable salt thereof. In some embodiments, the GLP-1 receptor agonist polypeptide is used to provide weight loss to a subject wherein the isolated polypeptide is of SEQ ID NO: 132 or a pharmaceutically acceptable salt thereof.

In some embodiments, the GLP-1 receptor agonist polypeptide is used for the treatment of a subject with NAFLD wherein the isolated polypeptide is of SEQ ID NO: 55 or a pharmaceutically acceptable salt thereof. In some embodiments, the GLP-1 receptor agonist polypeptide is used for the treatment of a subject with NAFLD wherein the isolated polypeptide is of SEQ ID NO: 115 or a pharmaceutically acceptable salt thereof. In some embodiments, the GLP-1 receptor agonist polypeptide is used for the treatment of a subject with NAFLD wherein the isolated polypeptide is of SEQ ID NO: 120 or a pharmaceutically acceptable salt thereof. In some embodiments, the GLP-1 receptor agonist polypeptide is used for the treatment of a subject with NAFLD wherein the isolated polypeptide is of SEQ ID NO: 132 or a pharmaceutically acceptable salt thereof.

In some embodiments, the GLP-1 receptor agonist polypeptide is used for the treatment of a subject with NASH wherein the isolated polypeptide is of SEQ ID NO: 55 or a pharmaceutically acceptable salt thereof. In some embodiments, the GLP-1 receptor agonist polypeptide is used for the treatment of a subject with NASH wherein the isolated polypeptide is of SEQ ID NO: 115 or a pharmaceutically acceptable salt thereof. In some embodiments, the GLP-1 receptor agonist polypeptide is used for the treatment of a subject with NASH wherein the isolated polypeptide is of SEQ ID NO: 120 or a pharmaceutically acceptable salt thereof. In some embodiments, the GLP-1 receptor agonist polypeptide is used for the treatment of a subject with NASH wherein the isolated polypeptide is of SEQ ID NO: 132 or a pharmaceutically acceptable salt thereof.

In some embodiments, provided is a method of treating a neurological disease or disorder in a human subject, comprising administering to the subject any of the polypeptides disclosed herein, a pharmaceutical composition comprising any of the disclosed polypeptides, or an osmotic delivery device comprising any of the disclosed polypeptides. In some embodiments, the neurological disease or disorder is selected from the group consisting of Parkinson's disease (PD) and Alzheimer's disease (AD).

In some embodiments, provided is a method of treating Parkinson's disease in a human subject, comprising administering to the subject any of the polypeptides disclosed herein, a pharmaceutical composition comprising any of the disclosed polypeptides, or an osmotic delivery device comprising any of the disclosed polypeptides. Moderately advanced PD patients that were treated with exenatide for 12 months in a clinical trial demonstrated improvement in motor and cognitive symptoms with the effects persisting for as long as 12 months after termination of the treatment (Aviles-Olmos, I., et al., J Clin Invest, 2013. 123(6): 2730-6; Athauda, D. and Foltynie, T., Drug Discov Today. 2016. 21(5):802-18; Simuni, T. and Brundin, P., J Parkinsons Dis, 2014. 4(3): 345-7).

In some embodiments, provided is a method of treating Alzheimer's disease in a human subject, comprising administering to the subject any of the polypeptides disclosed herein, a pharmaceutical composition comprising any of the disclosed polypeptides, or an osmotic delivery device comprising any of the disclosed polypeptides. Various AD preclinical studies have shown administration of GLP-1 receptor agonists affords neuroprotective effects with improvements to cognitive functions and positively affects most neuropathological features in AD (Grieco, M. et al., Front Neurosci. 2019; 13: 1112; Holscher, C., Acta Physiologica Sinica, 2014, 66(5): 497-510).

The terms "patient" or "subject" as used herein, refer to a rodent or an animal, preferably a mammal, and most preferably a human.

Combinations

In some embodiments, a GLP-1 receptor agonist polypeptide of the disclosure is co-formulated in combination with a second agent. In some embodiments, a GLP-1 receptor agonist polypeptide of the disclosure is co-formulated in combination with a second agent, wherein the second agent is an incretin mimetic. In some embodiments, a GLP-1 receptor agonist polypeptide of the disclosure is co-formulated in combination with a second agent, wherein the second agent is an insulinotropic compound.

Some embodiments of the present invention comprise use of a disclosed GLP-1 receptor agonist polypeptide of the present invention in combination with a second therapeutic agent, such as a second polypeptide, such as, by way of, non-limiting example, insulinotropic peptides, peptide hormones, for example, glucagon and incretin mimetics as well as peptide analogs and peptide derivatives thereof; glucagon like polypeptide-2 (GLP-2), PYY (also known as peptide YY, peptide tyrosine tyrosine), as well as peptide analogs and peptide derivatives thereof, for example, PYY(3-36); oxyntomodulin, as well as peptide analogs and peptide derivatives thereof); and gastric inhibitory peptide (GIP), as well as peptide analogs and peptide derivatives thereof. In some embodiments, a pharmaceutical composition comprising an GLP-1 receptor agonist polypeptide in combination with a second agent is used to treat type 2 diabetes.

In some embodiments, provided is a pharmaceutical composition comprising any of the isolated polypeptides as disclosed herein. In some embodiments, provided is a pharmaceutical composition comprising any of the isolated polypeptides as disclosed herein and further comprising a second polypeptide. In some embodiments, the second polypeptide is a glucagon receptor agonist. In some embodiments, the second polypeptide is a glucagon analog. In some embodiments, the second polypeptide is an amylin analog. In some embodiments, the second polypeptide is a PYY analog.

GLP-1, including three forms of the peptide, GLP-1(1-37), GLP-1(7-37) and GLP-1(7-36) amide, as well as peptide analogs of GLP-1 have been shown to stimulate insulin secretion (i.e., is insulinotropic), which induces glucose uptake by cells and results in decreases in serum glucose concentrations (see, e g., Mojsov, S., Int. J. Peptide Protein Research, 40:333-343 (1992)).

Numerous GLP-1 receptor agonists (e.g., GLP-1 peptide derivatives and peptide analogs) demonstrating insulinotropic action are known in the art (see, e.g., U.S. Pat. Nos. 5,118,666; 5,120,712; 5,512,549; 5,545,618; 5,574,008; 5,574,008; 5,614,492; 5,958,909; 6,191,102; 6,268,343; 6,329,336; 6,451,974; 6,458,924; 6,514,500; 6,593,295; 6,703,359; 6,706,689; 6,720,407; 6,821,949; 6,849,708; 6,849,714; 6,887,470; 6,887,849; 6,903,186; 7,022,674; 7,041,646; 7,084,243; 7,101,843; 7,138,486; 7,141,547; 7,144,863; and 7,199,217), as well as in clinical trials (e.g., taspoglutide and albiglutide). One example of a GLP-1 receptor agonist in the practice of the present invention is Victoza® (Novo Nordisk A/S, Bagsvaerd D K) (liraglutide; U.S. Pat. Nos. 6,268,343, 6,458,924, and 7,235,627). Once-daily injectable Victoza® (liraglutide) is commercially available in the United States, Europe, and Japan. Another example, of a GLP-1 receptor agonist is Ozempic® or Rybelsus® (Novo Nordisk A/S, Bagsvaerd D K) (semaglutide, injectable and orally administered formulations, respectively). For ease of reference herein, the family of GLP-1 receptor agonists, GLP-1 peptides, GLP-1 peptide derivatives and GLP-1 peptide analogs having insulinotropic activity is referred to collectively as "GLP-1."

Peptide YY (PYY) is a 36 amino acid residue peptide amide. PYY inhibits gut motility and blood flow (Laburthe, M., Trends Endocrinol Metab. 1(3):168-74 (1990), mediates intestinal secretion (Cox, H. M., et al., Br J Pharmacol 101(2):247-52 (1990); Playford, R. J., et al., Lancet 335 (8705):1555-7 (1990)), and stimulate net absorption (MacFayden, R. J., et al., Neuropeptides 7(3):219-27 (1986)). Two major in vivo variants, PYY(1-36) and PYY (3-36), have been identified (e.g., Eberlein, G. A., et al., Peptides 10(4), 797-803 (1989)). The sequence of PYY, as well as peptide analogs and peptide derivatives thereof, are known in the art (e.g., U.S. Pat. Nos. 5,574,010 and 5,552,520).

Oxyntomodulin is a naturally occurring 37 amino acid peptide hormone found in the colon that has been found to suppress appetite and facilitate weight loss (Wynne K, et al., Int J Obes (Lond) 30(12):1729-36(2006)). The sequence of oxyntomodulin, as well as peptide analogs and peptide derivatives thereof, are known in the art (e.g., Bataille D, et al., Peptides 2(Suppl 2):41-44 (1981); and U.S. Patent Publication Nos. 2005/0070469 and 2006/0094652).

Gastric Inhibitory Peptide (GIP) is an insulinotropic peptide hormone (Efendic, S., et al., Horm Metab Res. 36:742-6 (2004)) and is secreted by the mucosa of the duodenum and jejunum in response to absorbed fat and carbohydrate that stimulate the pancreas to secrete insulin. GIP circulates as a biologically active 42-amino acid peptide. GIP is also known as glucose-dependent insulinotropic protein. GIP is a 42-amino acid gastrointestinal regulatory peptide that stimulates insulin secretion from pancreatic beta cells in the presence of glucose (Tseng, C., et al., PNAS 90:1992-1996 (1993)). The sequence of GIP, as well as peptide analogs and peptide derivatives thereof, are known in the art (e.g., Meier J. J., Diabetes Metab Res Rev. 21(2):91-117 (2005) and Efendic S., Horm Metab Res. 36(11-12):742-6 (2004)).

Glucagon is a peptide hormone, produced by alpha cells of the pancreas, which raises the concentration of glucose in the bloodstream. Its effect is opposite that of insulin, which lowers the glucose concentration. The pancreas releases glucagon when the concentration of glucose in the bloodstream falls too low. Glucagon causes the liver to convert stored glycogen into glucose, which is released into the bloodstream. High blood glucose levels stimulate the release of insulin. Insulin allows glucose to be taken up and used by insulin-dependent tissues. Thus, glucagon and insulin are part of a feedback system that keeps blood glucose levels at a stable level.

Human amylin, or islet amyloid polypeptide (IAPP), is a 37-residue polypeptide hormone. Amylin is co-secreted with insulin from pancreatic β-cells in the ratio of approximately 100:1 (insulin:amylin). Pro-islet amyloid polypeptide (i.e., pro-IAPP) is produced in the pancreatic β-cells as a 67 amino acid, 7404 Dalton pro-peptide that undergoes post-translational modifications including protease cleavage to produce the 37-residue amylin. Loss of β-cell function that occurs early in type 1 diabetics and can occur late in type 2 diabetics leads to deficiencies in the secretion of insulin and amylin.

Amylin functions as part of the endocrine pancreas, those cells within the pancreas that synthesize and secrete hormones. Amylin contributes to glycemic control; it is secreted from the pancreatic islets into the blood circulation and is cleared by peptidases in the kidney. Amylin's metabolic function is well-characterized as an inhibitor of the appearance of nutrients, such as glucose, in the plasma. It thus functions as a synergistic partner to insulin, a peptide that regulates blood glucose levels and coordinates the body's distribution and uptake of glucose. Insulin's role in the body is, among other things, to prevent blood glucose levels from rising too high, particularly after a meal.

Amylin is believed to play a role in glycemic regulation by slowing gastric emptying and promoting satiety (i.e., feeling of fullness), thereby preventing post-prandial (i.e., after-meal) spikes in blood glucose levels. The overall effect is to slow the rate of appearance of glucose in the blood after eating. Amylin also lowers the secretion of glucagon by the pancreas. Glucagon's role in the body is, among other things, to prevent blood glucose levels dropping too low. This is significant because certain type 1 diabetics, for example, are prone to secrete excess amounts of the blood glucose-raising glucagon just after meals.

For numerous reasons, human amylin, having a half-life in serum of about 13 minutes, is not amenable for use as a therapeutic agent. Rather, pramlintide (Symlin®, developed by Amylin Pharmaceuticals, Inc., San Diego, CA, USA and marketed by AstraZeneca plc, Cambridge, UK) was developed as a synthetic analogue of human amylin for the treatment of patients with types 1 or 2 diabetes, who use meal-time insulin but cannot achieve desired glycemic control despite optimal insulin therapy. Pramlintide differs from human amylin in 3 of its 37 amino acids. These modifications provide pramlintide a longer half-life of approximately 48 minutes in humans and reduce its propensity to aggregate, a characteristic found of human amylin. Further analogues of human amylin have been disclosed such as those in U.S. patent application Ser. No. 16/598,915 (corresponding to PCT International Application No. PCT/US2019/ 055696), both filed Oct. 10, 2019.

Implantable Delivery

In some embodiments, provided is an osmotic delivery device, as described herein, comprising any of the long acting GLP-1 receptor agonist polypeptides, as disclosed herein, or a pharmaceutical composition comprising any of the long acting GLP-1 receptor agonist polypeptides.

In some embodiments, the osmotic delivery device comprises an impermeable reservoir comprising interior and exterior surfaces and first and second open ends; a semi-permeable membrane in sealing relationship with the first open end of the reservoir; an osmotic engine within the reservoir and adjacent the semi-permeable membrane; a piston adjacent the osmotic engine, wherein the piston forms a movable seal with the interior surface of the reservoir, the piston divides the reservoir into a first chamber and a second chamber, the first chamber comprising the osmotic engine; a suspension formulation, wherein the second chamber comprises the suspension formulation and the suspension formulation is flowable and comprises the isolated polypeptide; and a diffusion moderator inserted in the second open end of the reservoir, the diffusion moderator adjacent the suspension formulation.

An implantable, osmotic delivery device typically includes a reservoir having at least one orifice through which the suspension formulation is delivered. The suspension formulation may be stored within the reservoir. In a preferred embodiment, the implantable, drug delivery device is an osmotic delivery device, wherein delivery of the drug is osmotically driven. Some osmotic delivery devices and their component parts have been described, for example, the DUROS® delivery device or similar devices (see, e.g., U.S. Pat. Nos. 5,609,885; 5,728,396; 5,985,305; 5,997,527; 6,113,938; 6,132,420; 6,156,331; 6,217,906; 6,261,584; 6,270,787; 6,287,295; 6,375,978; 6,395,292; 6,508,808; 6,544,252; 6,635,268; 6,682,522; 6,923,800; 6,939,556; 6,976,981; 6,997,922; 7,014,636; 7,207,982; and 7,112,335; 7,163,688; U.S. Patent Publication Nos. 2005/0175701, 2007/0281024, 2008/0091176, and 2009/0202608).

The osmotic delivery device typically consists of a cylindrical reservoir which contains the osmotic engine, piston, and drug formulation. The reservoir is capped at one end by a controlled-rate, semi-permeable membrane and capped at the other end by a diffusion moderator through which suspension formulation, comprising the drug, is released from the drug reservoir. The piston separates the drug formulation from the osmotic engine and utilizes a seal to prevent the water in the osmotic engine compartment from entering the drug reservoir. The diffusion moderator is designed, in conjunction with the drug formulation, to prevent body fluid from entering the drug reservoir through the orifice.

The osmotic device releases a drug at a predetermined rate based on the principle of osmosis. Extracellular fluid enters the osmotic delivery device through a semi-permeable membrane directly into a salt engine that expands to drive the piston at a slow and even delivery rate. Movement of the piston forces the drug formulation to be released through the orifice or exit port at a predetermined shear rate. In one embodiment of the present invention, the reservoir of the osmotic device is loaded with a suspension formulation wherein the device is capable of delivering the suspension formulation to a subject over an extended period of time (e.g., about 1, about 3, about 6, about 9, about 10, and about 12 months) at a pre-determined, therapeutically effective delivery rate.

The release rate of the drug from the osmotic delivery device typically provides a subject with a predetermined target dose of a drug, for example, a therapeutically effective daily dose delivered over the course of a day; that is, the release rate of the drug from the device, provides substantial steady-state delivery of the drug at a therapeutic concentration to the subject.

Typically, for an osmotic delivery device, the volume of a beneficial agent chamber comprising the beneficial agent formulation is between about 100 µl to about 1000 µl, more preferably between about 120 µl and about 500 µl, more preferably between about 150 µl and about 200 µl.

Typically, the osmotic delivery device is implanted within the subject, for example, subdermally or subcutaneously to provide subcutaneous drug delivery. The device(s) can be implanted subdermally or subcutaneously into either or both arms (e.g., in the inside, outside, or back of the upper arm) or the abdomen. Preferred locations in the abdominal area are under the abdominal skin in the area extending below the ribs and above the belt line. To provide a number of locations for implantation of one or more osmotic delivery device within the abdomen, the abdominal wall can be divided into 4 quadrants as follows: the upper right quadrant extending at least 2-3 centimeters below the right ribs, e.g., at least about 5-8 centimeters below the right ribs, and at least 2-3 centimeters to the right of the midline, e.g., at least about 5-8 centimeters to the right of the midline; the lower right quadrant extending at least 2-3 centimeters above the belt line, e.g., at least about 5-8 centimeters above the belt line, and at least 2-3 centimeters to the right of the midline, e.g., at least about 5-8 centimeters to the right of the midline; the upper left quadrant extending at least 2-3 centimeters below the left ribs, e.g., at least about 5-8 centimeters below the left ribs, and at least 2-3 centimeters to the left of the midline, e.g., at least about 5-8 centimeters to the left of the midline; and the lower left quadrant extending at least 2-3 centimeters above the belt line, e.g., at least about 5-8 centimeters above the belt line, and at least 2-3 centimeters to the left of the midline, e.g., at least about 5-8 centimeters to the left of the midline. This provides multiple available locations for implantation of one or more devices on one or more occasions. Implantation and removal of osmotic delivery devices are generally carried out by medical professionals using local anesthesia (e.g., lidocaine).

Termination of treatment by removal of an osmotic delivery device from a subject is straightforward, and provides the important advantage of immediate cessation of delivery of the drug to the subject.

Preferably, the osmotic delivery device has a fail-safe mechanism to prevent an inadvertent excess or bolus delivery of drug in a theoretical situation like the plugging or clogging of the outlet (diffusion moderator) through which the drug formulation is delivered. To prevent an inadvertent excess or bolus delivery of drug the osmotic delivery device is designed and constructed such that the pressure needed to partially or wholly dislodge or expel the diffusion moderator from the reservoir exceeds the pressure needed to partially or wholly dislodge or expel the semi-permeable membrane to the extent necessary to de-pressurize the reservoir. In such a scenario, pressure would build within the device until it would push the semi-permeable membrane at the other end outward, thereby releasing the osmotic pressure. The osmotic delivery device would then become static and no longer deliver the drug formulation provided that the piston is in a sealing relationship with the reservoir.

A dose and delivery rate can be selected to achieve a desired blood concentration of a drug generally within less than about 6 half-lives of the drug within the subject after implantation of the device. The blood concentration of the drug is selected to give the optimal therapeutic effects of the drug while avoiding undesirable side effects that may be induced by excess concentration of the drug, while at the same time avoiding peaks and troughs that may induce side effects associated with peak or trough plasma concentrations of the drug.

The suspension formulations may also be used in infusion pumps, for example, the ALZET® (DURECT Corporation, Cupertino, Calif.) osmotic pumps which are miniature, infusion pumps for the continuous dosing of laboratory animals (e.g., mice and rats).

Modes of Administration

In some embodiments, the method comprises providing a GLP-1 receptor agonist polypeptide of the disclosure or a pharmaceutical composition thereof, to a subject in need of treatment, via injection. In some embodiments, the method comprises providing a GLP-1 receptor agonist polypeptide of the disclosure or a pharmaceutical composition thereof, formulated for oral administration, to a subject in need of treatment.

In some embodiments, the method comprises providing a GLP-1 receptor agonist polypeptide of the disclosure or a pharmaceutical composition thereof, to a subject in need of treatment, via implantation. In some embodiments, the method comprises providing continuous delivery of a GLP-1 receptor agonist polypeptide, to a subject in need of treatment, from an osmotic delivery device. The delivery device, such as an osmotic delivery device, comprises sufficient GLP-1 receptor agonist polypeptide of the disclosure for continuous administration for up to 3 months, 6 months, 9 months, 12 months, 18 months or 24 months. As such, continuous administration of a GLP-1 receptor agonist polypeptide of the disclosure via osmotic delivery device eliminates daily, or multiple daily dosing of marketed GLP-1 receptor agonist polypeptides.

The substantial steady-state delivery of the GLP-1 receptor agonist polypeptide from the osmotic delivery device is continuous over an administration period. In some embodiments, the subject or patient is a human subject or human patient.

In some embodiments of the present invention, the administration period is, for example, at least about 3 months, at least about 3 months to about a year, at least about 4 months to about a year, at least about 5 months to about a year, at least about 6 months to about a year, at least about 8 months to about a year, at least about 9 months to about a year, at least about 10 months to about a year, at least about one year to about two years, at least about two years to about three years.

In further embodiments, the treatment methods of the present invention provide significant decrease in the subject's fasting plasma glucose concentration after implantation of the osmotic delivery device in the subject (relative to the subject's fasting plasma glucose concentration before implantation of the osmotic delivery device) that is achieved within about 7 days, 6 days, 5 days, 4 days, 3 days, 2 days, 1 day or less after implantation of the osmotic delivery device in the subject. The significant decrease in fasting plasma glucose is typically statistically significant as demonstrated by application of an appropriate statistical test or is considered significant for the subject by a medical practitioner. A significant decrease in fasting plasma glucose relative to the baseline before implantation is typically maintained over the administration period.

In some embodiments, the present invention relates to a method of treating a disease or condition in a subject in need of treatment. The method comprises providing continuous delivery of a drug from an osmotic delivery device, wherein substantial steady-state delivery of the drug at therapeutic concentrations is achieved in the subject. The substantial steady-state delivery of the drug from the osmotic delivery device is continuous over an administration period of at least about 3 months. The drug has a known or determined half-life in a typical subject. Humans are preferred subjects for the practice of the present invention. The present invention includes a drug effective for treatment of the disease or condition, as well as an osmotic delivery device comprising the drug for use in the present methods of treating the disease or condition in a subject in need of treatment. Advantages of the present invention include mitigation of peak-associated drug toxicities and attenuation of sub-optimal drug therapy associated with troughs.

In some embodiments, the substantial steady-state delivery of a drug at therapeutic concentrations is achieved within a period of about 1 month, 7 days, 5 days, 3 days or 1 day after implantation of the osmotic delivery device in the subject.

The invention also provides a method for promoting weight loss in a subject in need thereof, a method for treating excess weight or obesity in a subject in need thereof, and/or a method for suppressing appetite in a subject in need thereof. The method comprises providing delivery of an isolated GLP-1 receptor agonist polypeptide. In some embodiments, the isolated GLP-1 receptor agonist polypeptide is continuously delivered from an implantable osmotic delivery device. In some embodiments, substantial steady-state delivery of the GLP-1 receptor agonist polypeptide from the osmotic delivery device is achieved and is substantially continuous over an administration period. In some embodiments, the subject is human.

The present invention includes an osmotic delivery device comprising a GLP-1 receptor agonist polypeptide for use in the present methods in a subject in need of treatment. The subject may have type 2 diabetes. The subject in need thereof may have a baseline HbA1c % of greater than 10.0%, i.e., a high baseline (HBL) subject. The subject may not have previously received a drug for treating type 2 diabetes mellitus.

In further embodiments, the treatment methods of the present invention provide significant decrease in the subject's fasting plasma glucose concentration after implantation of the osmotic delivery device in the subject (relative to the subject's fasting plasma glucose concentration before implantation of the osmotic delivery device) that is achieved within about 7 days or less after implantation of the osmotic delivery device in the subject, within about 6 days or less after implantation of the osmotic delivery device in the subject, within about 5 days or less after implantation of the osmotic delivery device in the subject, within about 4 days or less after implantation of the osmotic delivery device in the subject, within about 3 days or less after implantation of the osmotic delivery device in the subject, within about 2 days or less after implantation of the osmotic delivery device in the subject, or within about 1 day or less after implantation of the osmotic delivery device in the subject. In preferred embodiments of the present invention, the significant decrease in the subject's fasting plasma glucose concentration after implantation of the osmotic delivery device, relative to the subject's fasting plasma glucose concentration before implantation, is achieved within about 2 days or less, preferably within about 1 day or less after implantation of the osmotic delivery device in the subject, or more preferably within about 1 day after implantation of the osmotic delivery device in the subject. The significant decrease in fasting plasma glucose is typically statistically significant as demonstrated by application of an appropriate statistical test or is considered significant for the subject by a medical practitioner. A significant decrease in fasting plasma glucose relative to the baseline before implantation is typically maintained over the administration period.

In embodiments of all aspects of the present invention relating to methods of treating a disease or condition in a subject, an exemplary osmotic delivery device comprises the following: an impermeable reservoir comprising interior and exterior surfaces and first and second open ends; a semi-permeable membrane in sealing relationship with the first open end of the reservoir; an osmotic engine within the reservoir and adjacent the semi-permeable membrane; a piston adjacent the osmotic engine, wherein the piston forms a movable seal with the interior surface of the reservoir, the piston divides the reservoir into a first chamber and a second chamber, the first chamber comprising the osmotic engine; a drug formulation or suspension formulation comprising the drug, wherein the second chamber comprises the drug formulation or suspension formulation and the drug formulation or suspension formulation is flowable; and a diffusion moderator inserted in the second open end of the reservoir, the diffusion moderator adjacent the suspension formulation. In preferred embodiments, the reservoir comprises titanium or a titanium alloy.

In embodiments of all aspects of the present invention relating to methods of treating a disease or condition in a subject, the drug formulation can comprise the drug and a vehicle formulation. Alternatively, suspension formulations are used in the methods and can, for example, comprise a particle formulation comprising the drug and a vehicle formulation. Vehicle formulations for use in forming the suspension formulations of the present invention can, for example, comprise a solvent and a polymer.

The reservoir of the osmotic delivery devices may, for example, comprise titanium or a titanium alloy.

In embodiments of all aspects of the present invention the implanted osmotic delivery device can be used to provide subcutaneous delivery.

In embodiments of all aspects of the present invention the continuous delivery can, for example, be zero-order, controlled continuous delivery.

Pharmaceutical Compositions

According to another embodiment, the invention provides a pharmaceutical composition comprising a compound, i.e., isolated polypeptide, of this invention or a pharmaceutically acceptable derivative thereof and a pharmaceutically acceptable carrier, adjuvant, or vehicle.

In some embodiments, provided is a pharmaceutical composition comprising any of the disclosed polypeptides formulated as a or pharmaceutically acceptable salts thereof, such as a trifluoroacetate salt, acetate salt or hydrochloride salt. In some embodiments, provided is a pharmaceutical composition comprising any of the disclosed polypeptides formulated as a trifluoroacetate salt. In some embodiments, provided is a pharmaceutical composition comprising any of the disclosed polypeptides formulated as an acetate salt. In some embodiments, provided is a pharmaceutical composition comprising any of the disclosed polypeptides formulated as a hydrochloride salt.

The term "pharmaceutically acceptable carrier, adjuvant, or vehicle" refers to a non-toxic carrier, adjuvant, or vehicle that does not destroy the pharmacological activity of the compound with which it is formulated.

As used herein, the term "pharmaceutically acceptable carrier" is intended to include any and all solvents, polymers, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, ringer's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

Representative pharmaceutically acceptable carriers, adjuvants or vehicles that may be used in the compositions of this invention include, but are not limited to, ion exchangers, alumina, aluminum stearate, lecithin, serum proteins, such as human serum albumin, buffer substances such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropylene-block polymers, polyethylene glycol and wool fat.

In some embodiments, provided is a pharmaceutical composition comprising a pharmaceutically acceptable derivative of any of the disclosed polypeptides formulated as a or pharmaceutically acceptable salts thereof, such as a trifluoroacetate salt, acetate salt or hydrochloride salt. A "pharmaceutically acceptable derivative" means any non-toxic salt, ester, salt of an ester or other derivative of a compound of this invention that, upon administration to a recipient, is capable of providing, either directly or indirectly, a compound of this invention or an active metabolite or residue thereof.

The pharmaceutical composition comprises a drug and may be formulated as a "particle formulation" as described in greater detail below. The pharmaceutical composition and/or particle formulation may include stabilizing components (also referred to herein as "excipients"). Examples of stabilizing components include, but are not limited to, carbohydrates, antioxidants, amino acids, buffers, inorganic compounds, and surfactants.

The amount of compound in compositions of this invention is such that is effective to measurably activate one or more GLP-1 receptors (e.g., human, rat, monkey etc.), in a biological sample or in a patient. In certain embodiments, the amount of compound in compositions of this invention is such that is effective to measurably agonize human GLP-1 receptor in the absence or presence of human serum albumin, in a biological sample or in a patient. In certain embodiments, a composition of this invention is formulated for administration to a patient in need of such composition. In some embodiments, a composition of this invention is formulated for injectable administration to a patient. In some embodiments, a composition of this invention is formulated for administration to a patient via an implantable delivery device such as an osmotic deliver device.

The isolated polypeptides of the disclosure (also referred to herein as "active compounds"), and derivatives, fragments, analogs and homologs thereof, can be incorporated into pharmaceutical compositions suitable for administration. Such compositions typically comprise the isolated polypeptide, or a pharmaceutically acceptable salt thereof, and a pharmaceutically acceptable carrier.

A pharmaceutical composition of the invention is formulated to be compatible with its intended route of administration. Examples of routes of administration include parenteral, (e.g., intravenous, intradermal, subdermal, subcutaneous), oral (e.g., inhalation), transdermal (i.e., topical), transmucosal, rectal, or combinations thereof. In some embodiments, a pharmaceutical composition or an isolated polypeptide of the disclosure is formulated for administration by topical administration. In some embodiments, a pharmaceutical composition or an isolated polypeptide of the disclosure is formulated for administration by inhalation administration. In some embodiments, the pharmaceutical composition is formulated for administration by a device or other suitable delivery mechanism that is suitable for subdermal or subcutaneous implantation and delivers the pharmaceutical composition subcutaneously. In some embodiments, the pharmaceutical composition is formulated for administration by an implant device that is suitable for subdermal or subcutaneous implantation and delivers the pharmaceutical composition subcutaneously. In some embodiments, the pharmaceutical composition is formulated for administration by an osmotic delivery device, e.g., an implantable osmotic delivery device, that is suitable for subdermal or subcutaneous placement or other implantation and delivers the pharmaceutical composition subcutaneously. Solutions or suspensions used for parenteral application, intradermal application, subdermal application, subcutaneous application, or combinations thereof can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The pharmaceutical compositions can be included in a container, pack, or dispenser together with instructions for administration.

Drug Particle Formulations

Compounds, i.e., isolated polypeptides or pharmaceutically acceptable salts thereof, for use in the practice of the present invention are typically added to particle formulations, which are used to make polypeptide-containing particles that are uniformly suspended, dissolved or dispersed in a suspension vehicle to form a suspension formulation. In some embodiments, the GLP-1 receptor agonist polypeptide is formulated in a particle formulation and converted (e.g., spray dried) to particles. In some embodiments, the particles are comprising the GLP-1 receptor agonist polypeptide are suspended in a vehicle formulation, resulting in a suspension formulation of vehicle and suspended particles comprising the GLP-1 receptor agonist polypeptide.

Preferably, particle formulations are formable into particles using processes such as spray drying, lyophilization, desiccation, freeze-drying, milling, granulation, ultrasonic drop creation, crystallization, precipitation, or other techniques available in the art for forming particles from a mixture of components. In one embodiment of the invention the particles are spray dried. The particles are preferably substantially uniform in shape and size.

In some embodiments, the present invention provides drug particle formulations for pharmaceutical use. The particle formulation typically comprises a drug and includes one or more stabilizing component (also referred to herein as "excipients"). Examples of stabilizing components include, but are not limited to, carbohydrates, antioxidants, amino acids, buffers, inorganic compounds, and surfactants. The amounts of stabilizers in the particle formulation can be determined experimentally based on the activities of the stabilizers and the desired characteristics of the formulation, in view of the teachings of the present specification.

In any of the embodiments, the particle formulation may comprise about 50 wt % to about 90 wt % drug, about 50 wt % to about 85 wt % drug, about 55 wt % to about 90 wt % drug, about 60 wt % to about 90 wt % drug, about 65 wt % to about 85 wt % drug, about 65 wt % to about 90 wt % drug, about 70 wt % to about 90 wt % drug, about 70 wt % to about 85 wt % drug, about 70 wt % to about 80 wt % drug, or about 70 wt % to about 75 wt % drug.

Typically, the amount of carbohydrate in the particle formulation is determined by aggregation concerns. In general, the carbohydrate amount should not be too high so as to avoid promoting crystal growth in the presence of water due to excess carbohydrate unbound to drug.

Typically, the amount of antioxidant in the particle formulation is determined by oxidation concerns, while the amount of amino acid in the formulation is determined by oxidation concerns and/or formability of particles during spray drying.

Typically, the amount of buffer in the particle formulation is determined by pre-processing concerns, stability concerns, and formability of particles during spray drying. Buffer may be required to stabilize drug during processing, e.g., solution preparation and spray drying, when all stabilizers are solubilized.

Examples of carbohydrates that may be included in the particle formulation include, but are not limited to, monosaccharides (e.g., fructose, maltose, galactose, glucose, D-mannose, and sorbose), disaccharides (e.g., lactose, sucrose, trehalose, and cellobiose), polysaccharides (e.g., raffinose, melezitose, maltodextrins, dextrans, and starches), and alditols (acyclic polyols; e.g., mannitol, xylitol, maltitol, lactitol, xylitol sorbitol, pyranosyl sorbitol, and myoinsitol). Suitable carbohydrates include disaccharides and/or non-reducing sugars, such as sucrose, trehalose, and raffinose.

Examples of antioxidants that may be included in the particle formulation include, but are not limited to, methionine, ascorbic acid, sodium thiosulfate, catalase, platinum, ethylenediaminetetraacetic acid (EDTA), citric acid, cysteine, thioglycerol, thioglycolic acid, thiosorbitol, butylated hydroxanisol, butylated hydroxyltoluene, and propyl gallate. Further, amino acids that readily oxidize can be used as antioxidants, for example, cysteine, methionine, and tryptophan.

Examples of amino acids that may be included in the particle formulation include, but are not limited to, arginine, methionine, glycine, histidine, alanine, leucine, glutamic acid, iso-leucine, L-threonine, 2-phenylamine, valine, norvaline, proline, phenylalanine, tryptophan, serine, asparagines, cysteine, tyrosine, lysine, and norleucine. Suitable amino acids include those that readily oxidize, e.g., cysteine, methionine, and tryptophan.

Examples of buffers that may be included in the particle formulation include, but are not limited to, citrate, histidine, succinate, phosphate, maleate, tris, acetate, carbohydrate, and gly-gly. Suitable buffers include citrate, histidine, succinate, and tris.

Examples of inorganic compounds that may be included in the particle formulation include, but are not limited to, NaCl, $Na_2SO_4$, $NaHCO_3$, KCl, $KH_2PO_4$, $CaCl_2$, and $MgCl_2$.

In addition, the particle formulation may include other stabilizers/excipients, such as surfactants and salts. Examples of surfactants include, but are not limited to, Polysorbate 20, Polysorbate 80, PLURONIC® (BASF Corporation, Mount Olive, N.J.) F68, and sodium dodecyl sulfate (SDS). Examples of salts include, but are not limited to, sodium chloride, calcium chloride, and magnesium chloride.

The particles are typically sized such that they can be delivered via an implantable osmotic delivery device. Uniform shape and size of the particles typically helps to provide a consistent and uniform rate of release from such a delivery device; however, a particle preparation having a non-normal particle size distribution profile may also be used. For example, in a typical implantable osmotic delivery device having a delivery orifice, the size of the particles is less than about 30%, more preferably is less than about 20%, more preferably is less than about than 10%, of the diameter of the delivery orifice. In an embodiment of the particle formulation for use with an osmotic delivery system, wherein the delivery orifice diameter of the implant is about 0.5 mm, particle sizes may be, for example, less than about 150 microns to about 50 microns. In an embodiment of the particle formulation for use with an osmotic delivery system, wherein the delivery orifice diameter of the implant is about 0.1 mm, particle sizes may be, for example, less than about 30 microns to about 10 microns. In one embodiment, the orifice is about 0.25 mm (250 microns) and the particle size is about 2 microns to about 5 microns.

Those of ordinary skill in the art will appreciate that a population of particles follow principles of particle size distribution. Widely used, art-recognized methods of describing particle size distributions include, for example, average diameters and D values, such as the D50 value, which is commonly used to represent the mean diameter of the range of the particle sizes of a given sample.

Particles of a particle formulation have diameters of between about 2 microns to about 150 micron, e.g., less than 150 microns in diameter, less than 100 microns in diameter, less than 50 microns in diameter, less than 30 microns in diameter, less than 10 microns in diameter, less than microns in diameter, and about 2 microns in diameter. Preferably, particles have diameters of between about 2 microns and about 50 microns.

Particles of a particle formulation comprising an isolated GLP-1 receptor agonist polypeptide have average diameters of between about 0.3 microns to about 150 microns. Particles of a particle formulation comprising an isolated GLP-1 receptor agonist polypeptide have average diameters of between about 2 microns to about 150 microns, e.g., less than 150 microns in average diameter, less than 100 microns in average diameter, less than 50 microns in average diameter, less than 30 microns in average diameter, less than 10 microns in average diameter, less than 5 microns in average diameter, and about 2 microns in average diameter. In some embodiments, particles have average diameters of between about 0.3 microns and 50 microns, for example, between about 2 microns and about 50 microns. In some embodiments, the particles have an average diameter between 0.3 microns and 50 microns, for example, between about 2 microns and about 50 microns, where each particle is less than about 50 microns in diameter.

Typically, the particles of the particle formulations, when incorporated in a suspension vehicle, do not settle in less than about 3 months, preferably do not settle in less than about 6 months, more preferably do not settle in less than about 12 months, more preferably do not settle in less than about 24 months at delivery temperature, and most preferably do not settle in less than about 36 months at delivery temperature. The suspension vehicles typically have a viscosity of between about 5,000 to about 30,000 poise, preferably between about 8,000 to about 25,000 poise, more preferably between about 10,000 to about 20,000 poise. In one embodiment, the suspension vehicle has a viscosity of about 15,000 poise, plus or minus about 3,000 poise. Generally speaking, smaller particles tend to have a lower settling rate in viscous suspension vehicles than larger particles. Accordingly, micron- to nano-sized particles are typically desirable. In viscous suspension formulation, particles of about 2 microns to about 7 microns of the present invention will not settle for at least 20 years at room temperature based on simulation modeling studies. In an embodiment of the particle formulation of the present invention, for use in an implantable osmotic delivery device, comprises particles of sizes less than about 50 microns, more preferably less than about 10 microns, more preferably in a range from about 2 microns to about 7 microns.

In summary, disclosed polypeptides, or pharmaceutically acceptable salts thereof, are formulated into dried powders in solid state particles, which preserve maximum chemical and biological stability of the drug. Particles offers long-term storage stability at high temperature, and therefore, allows delivery to a subject of stable and biologically effective drug for extended periods of time. Particles are suspended in suspension vehicles for administration to patients.

Particle Suspensions in Vehicles

In one aspect, the suspension vehicle provides a stable environment in which the drug particle formulation is dispersed. The drug particle formulations are chemically and physically stable (as described above) in the suspension vehicle. The suspension vehicle typically comprises one or more polymer and one or more solvent that form a solution of sufficient viscosity to uniformly suspend the particles comprising the drug. The suspension vehicle may comprise further components, including, but not limited to, surfactants, antioxidants, and/or other compounds soluble in the vehicle.

The viscosity of the suspension vehicle is typically sufficient to prevent the drug particle formulation from settling during storage and use in a method of delivery, for example, in an implantable, osmotic delivery device. The suspension vehicle is biodegradable in that the suspension vehicle disintegrates or breaks down over a period of time in response to a biological environment, while the drug particle is dissolved in the biological environment and the active pharmaceutical ingredient (i.e., the drug) in the particle is absorbed.

In embodiments, the suspension vehicle is a "single-phase" suspension vehicle, which is a solid, semisolid, or liquid homogeneous system that is physically and chemically uniform throughout.

The solvent in which the polymer is dissolved may affect characteristics of the suspension formulation, such as the behavior of drug particle formulation during storage. A solvent may be selected in combination with a polymer so that the resulting suspension vehicle exhibits phase separation upon contact with the aqueous environment. In some embodiments of the invention, the solvent may be selected in combination with the polymer so that the resulting suspension vehicle exhibits phase separation upon contact with the aqueous environment having less than approximately about 10% water.

The solvent may be an acceptable solvent that is not miscible with water. The solvent may also be selected so that the polymer is soluble in the solvent at high concentrations, such as at a polymer concentration of greater than about 30%. Examples of solvents useful in the practice of the present invention include, but are not limited to, lauryl alcohol, benzyl benzoate, benzyl alcohol, lauryl lactate, decanol (also called decyl alcohol), ethyl hexyl lactate, and long chain (C8 to C24) aliphatic alcohols, esters, or mixtures thereof. The solvent used in the suspension vehicle may be "dry," in that it has a low moisture content. Preferred solvents for use in formulation of the suspension vehicle include lauryl lactate, lauryl alcohol, benzyl benzoate, and mixtures thereof.

Examples of polymers for formulation of the suspension vehicles of the present invention include, but are not limited to, a polyester (e.g., polylactic acid and polylacticpolyglycolic acid), a polymer comprising pyrrolidones (e.g., polyvinylpyrrolidone having a molecular weight ranging from approximately 2,000 to approximately 1,000,000), ester or ether of an unsaturated alcohol (e.g., vinyl acetate), polyoxyethylenepolyoxypropylene block copolymer, or mixtures thereof. Polyvinylpyrrolidone can be characterized by its K-value (e.g., K-17), which is a viscosity index. In one embodiment, the polymer is polyvinylpyrrolidone having a molecular weight of 2,000 to 1,000,000. In a preferred embodiment, the polymer is polyvinylpyrrolidone K-17 (typically having an approximate average molecular weight range of 7,900-10,800). The polymer used in the suspension vehicle may include one or more different polymers or may include different grades of a single polymer. The polymer used in the suspension vehicle may also be dry or have a low moisture content.

Generally speaking, a suspension vehicle for use in the present invention may vary in composition based on the desired performance characteristics. In one embodiment, the suspension vehicle may comprise about 40 wt % to about 80 wt % polymer(s) and about 20 wt % to about 60 wt % solvent(s). Preferred embodiments of a suspension vehicle include vehicles formed of polymer(s) and solvent(s) combined at the following ratios: about 25 wt % solvent and about 75 wt % polymer; about 50 wt % solvent and about 50 wt % polymer; about 75 wt % solvent and about 25 wt % polymer. Accordingly, in some embodiments, the suspension vehicle may comprise selected components and in other embodiments consist essentially of selected components.

The suspension vehicle may exhibit Newtonian behavior. The suspension vehicle is typically formulated to provide a viscosity that maintains a uniform dispersion of the particle formulation for a predetermined period of time. This helps facilitate making a suspension formulation tailored to provide controlled delivery of the drug contained in the drug particle formulation. The viscosity of the suspension vehicle may vary depending on the desired application, the size and type of the particle formulation, and the loading of the particle formulation in the suspension vehicle. The viscosity of the suspension vehicle may be varied by altering the type or relative amount of the solvent or polymer used.

The suspension vehicle may have a viscosity ranging from about 100 poise to about 1,000,000 poise, preferably from about 1,000 poise to about 100,000 poise. In preferred embodiments, the suspension vehicles typically have a viscosity, at 33° C., of between about 5,000 to about 30,000 poise, preferably between about 8,000 to about 25,000 poise, more preferably between about 10,000 to about 20,000 poise. In one embodiment, the suspension vehicle has a viscosity of about 15,000 poise, plus or minus about 3,000 poise, at 33° C. The viscosity may be measured at 33° C., at a shear rate of 10-4/sec, using a parallel plate rheometer.

The suspension vehicle may exhibit phase separation when contacted with the aqueous environment; however, typically the suspension vehicle exhibits substantially no phase separation as a function of temperature. For example, at a temperature ranging from approximately 0° C. to approximately 70° C. and upon temperature cycling, such as cycling from 4° C. to 37° C. to 4° C., the suspension vehicle typically exhibits no phase separation.

The suspension vehicle may be prepared by combining the polymer and the solvent under dry conditions, such as in a dry box. The polymer and solvent may be combined at an elevated temperature, such as from approximately 40° C. to approximately 70° C., and allowed to liquefy and form the single phase. The ingredients may be blended under vacuum to remove air bubbles produced from the dry ingredients. The ingredients may be combined using a conventional mixer, such as a dual helix blade or similar mixer, set at a speed of approximately 40 rpm. However, higher speeds may also be used to mix the ingredients. Once a liquid solution of the ingredients is achieved, the suspension vehicle may be cooled to room temperature. Differential scanning calorimetry (DSC) may be used to verify that the suspension vehicle is a single phase. Further, the components of the vehicle (e.g., the solvent and/or the polymer) may be treated to substantially reduce or substantially remove peroxides (e.g., by treatment with methionine; see, e.g., U.S., Patent Application Publication No. 2007-0027105).

The drug particle formulation is added to the suspension vehicle to form a suspension formulation. In some embodiments, the suspension formulation may comprise a drug particle formulation and a suspension vehicle and in other embodiments consist essentially of a drug particle formulation and a suspension vehicle.

The suspension formulation may be prepared by dispersing the particle formulation in the suspension vehicle. The suspension vehicle may be heated and the particle formulation added to the suspension vehicle under dry conditions. The ingredients may be mixed under vacuum at an elevated temperature, such as from about 40° C. to about 70° C. The ingredients may be mixed at a sufficient speed, such as from about 40 rpm to about 120 rpm, and for a sufficient amount of time, such as about 15 minutes, to achieve a uniform dispersion of the particle formulation in the suspension vehicle. The mixer may be a dual helix blade or other suitable mixer. The resulting mixture may be removed from the mixer, sealed in a dry container to prevent water from contaminating the suspension formulation, and allowed to cool to room temperature before further use, for example, loading into an implantable, drug delivery device, unit dose container, or multiple-dose container.

The suspension formulation typically has an overall moisture content of less than about 10 wt %, preferably less than about 5 wt %, and more preferably less than about 4 wt %.

In preferred embodiments, the suspension formulations of the present invention are substantially homogeneous and flowable to provide delivery of the drug particle formulation from the osmotic delivery device to the subject.

In summary, the components of the suspension vehicle provide biocompatibility. Components of the suspension vehicle offer suitable chemico-physical properties to form stable suspensions of drug particle formulations. These properties include, but are not limited to, the following: viscosity of the suspension; purity of the vehicle; residual moisture of the vehicle; density of the vehicle; compatibility with the dry powders; compatibility with implantable devices; molecular weight of the polymer; stability of the vehicle; and hydrophobicity and hydrophilicity of the vehicle. These properties can be manipulated and controlled, for example, by variation of the vehicle composition and manipulation of the ratio of components used in the suspension vehicle.

The suspension formulations described herein may be used in an implantable, osmotic delivery device to provide zero-order, continuous, controlled, and sustained delivery of a compound over an extended period of time, such as over weeks, months, or up to about one year or more. Such an implantable osmotic delivery device is typically capable of delivering the suspension formulation, comprising the drug, at a desired flow rate over a desired period of time. The suspension formulation may be loaded into the implantable, osmotic delivery device by conventional techniques.

EXAMPLES

The following examples are put forth so as to provide those of ordinary skill in the art with a complete disclosure and description of how to practice the present invention, and are not intended to limit the scope of what the inventors regard as the invention. Efforts have been made to ensure accuracy with respect to numbers used (e.g., amounts, concentrations, and percent changes) but some experimental errors and deviations should be accounted for. Unless indicated otherwise, temperature is in degrees Centigrade and pressure is at or near atmospheric.

Example 1: Generation of a Long Acting GLP-1 Receptor Agonist Polypeptides

Long acting GLP-1 receptor agonist polypeptides of the invention, as provided in Table 4, were synthesized on a Prelude peptide synthesizer (Protein Technologies Inc., Tucson, AZ)) by solid-phase methods using Fmoc strategy with N-[(dimethylamino)-1H-1,2,3-triazolo-[4,5-b]pyridin-1-yl-methylene]-N-methylmethanaminium hexafluorophosphate N-oxide (HATU) or 2-(6-chloro-1-H-benzotriazole-1-yl)-1, 1,3,3-tetramethylaminium hexafluorophosphate (HCTU) activation (5-fold molar excess to amino acid) in N,N-dimethylformamide (DMF), and N'N-diisopropylethylamine (DIEA) was used as base. A 20% piperidine/DMF solution was used for Fmoc deprotection. The resin used was Rink Amide MBHA LL (Novabiochem) with loading of (0.30-0.40) mmol/g on a (20-400) μmol scale.

Upon completion of solid phase synthesis of the linear polypeptide, the resin was washed with dichloromethane (DCM) and dried under vacuum for 30 minutes. For analogs containing the allyloxycarbonyl (Alloc) protecting group, removal was accomplished via a solution of Pd $(PPh_3)_3$ in (chloroform/acetic acid/n-methyl-morpholine, 37:2:1). For analogs containing the tert-butyloxycarbonyl (BOC)-Lys-fluorenylmethyloxycarbonyl (Fmoc)-OH, the Fmoc protecting group was removed using 20% piperidine/DMF. The resulting Fmoc-deprotected resin was washed with DMF (6×30 secs). Next, elongation of the spacer region was carried out in step wise manner with the manual addition of each building block under pre-activation conditions. Addition of the lipophilic substituent (also referred to as "acyl chain") was carried out under solid-phase peptide synthesis (SPPS) conditions with no pre-activation step. Final deprotection and cleavage of the peptide from the solid support were performed by treatment of the resin with (95% TFA, 2% water, 2% thioanisole, and 1% triisopropylsilane) for 2-3 hours. The cleaved peptide was precipitated using cold diethyl ether. The diethyl ether layer was decanted, and the solids triturated again with cold diethyl ether and pelleted by centrifugation.

For analogs containing a lactam bridge, the appropriate allyl-protected amino acid building blocks were installed under normal solid-phase conditions as described above. Also, Fmoc-Lys-ε-1-(4,4-dimethyl-2,6-dioxocyclohex-1-ylidene)-3-methylbutyl(ivDde)-OH was installed as a handle to later incorporate the acyl spacer and side-chain. Upon completion of the linear peptide the allyl-protecting groups were removed as described above. Lactam-bridge formation was afforded via solid-phase protocol using benzotriazol-1-yl-oxytripyrrolidinophosphonium hexafluorophosphate (PyBOP, 0.5M) activation and DIEA as the base. Deprotection of the Fmoc & ivDde groups was afforded via 4% solution of hydrazine in DMF. The resulting de-protected resin was washed with DMF (6×30 secs). Elongation of the spacer region and addition of a lipophilic substituent was carried out as described in the preceding paragraphs. Final deprotection and cleavage of the peptide from the solid support was performed by treatment of the resin with (95% TFA, 2% water, 2% thioanisole, and 1% triisopropylsilane) for 2-3 hours. The cleaved peptide was precipitated using cold diethyl ether. The diethyl ether was decanted, and the solids triturated again with cold diethyl ether and pelleted by centrifugation.

The crude product was next dissolved in a solution of acetonitrile (ACN)/H$_2$O, 0.1% TFA. A 10% solution of acetic acid was added to each solution of crude peptide product and allowed to stir until analysis via LC/MS indicated removal of any CO$_2$ adducts. The solution was frozen and lyophilized. Purification was afforded via the methods described in Example 2.

Example 2: Purification and Characterization of Long Acting GLP-1 Receptor Agonist Polypeptides, i.e., Linear Polypeptide, without any Lipophilic Substituent and Optional Spacer The product of Example 1 was lyophilized and analyzed by electrospray ionization—liquid chromatography/mass spectrometry (ESI-LC/MS) and analytical high-pressure liquid chromatography (HPLC) and was demonstrated to be pure (>98%). Mass results were consistent with calculated values.

Characterizations of peptide analogs were performed via C18 HPLC and LC/MS analysis (Acquity SQD Waters Corp, Milford, MA) and UV detection provided by dual absorbance signals at 215 nm and 280 nm, using one of Method A, Method B, Method C or Method D.

Method A, LC/MS conditions: performed using a Phenomenex HPLC Aeris™ Peptide XB C18 35 column, 1.7 µm, 2.1×100 mm or Acquity BEH300 or BEH130 CT8 column, 1.77 pm. 2.1×100 mm using 5-65% acetonitrile/water with 0.05% TFA over 30 minutes with a flow rate 0.5 mL/min, λ—215 nm, 280 nm.

Method B, C18 HPLC conditions: HPLC analysis was conducted on an Acquity BEH130, C18 column, 1.7 µm, 100×2.10 mm column at 25° C., 5-65% acetonitrile/water with 0.05% TFA over 30 minutes, flow rate 0.5 mL/min, λ—215 nm, 280 nm.

Method C, HPLC conditions: HPLC analysis was conducted on an Acquity BEH130, C18 column, 1.7 µm, 100×2.10 mm column at 25° C., 5-65% acetonitrile/water with 0.05% TFA over 20 minutes, flow rate 0.5 mL/min, λ—215 nm, 280 nm.

Method D, HPLC conditions: HPLC analysis was conducted on an Acquity BEH130, C18 column, 1.7 µm, 100×2.10 mm column at 25° C., 5-65% acetonitrile/water with 0.05% TFA over 10 minutes, flow rate 0.5 mL/min, λ—215 nm, 280 nm. 5.0 µL of sample was injected using a PLNO (partial loop w/needle over-fill) injection mode.

Table 10 provides exemplary long acting GLP-1 receptor agonist polypeptides of the disclosure.

Polypeptide analogs without a lipophilic substituent and optional spacer are sometimes referred to herein as "linear polypeptides." Polypeptide analogs having at least one covalently bound lipophilic substituent and optional spacer are sometimes referred to herein as "conjugated polypeptides."

TABLE 10

Exemplary compounds: GLP-1 receptor agonist polypeptides

| Compound No. | SEQ ID NO: | Molecular Formula | Parent MW | Calculated Mass (M + 3/3) | Observed Mass (M + 3/3) |
|---|---|---|---|---|---|
| A1 | SEQ ID NO: 1 | $C_{220}H_{346}N_{54}O_{72}$ | 4899.49 | 1634.16 | 1635.8 |
| A2 | SEQ ID NO: 2 | $C_{220}H_{348}N_{54}O_{70}S$ | 4901.57 | 1634.86 | 1636.9 |
| A3 | SEQ ID NO: 3 | $C_{222}H_{350}N_{54}O_{72}S$ | 4959.61 | 1654.2 | 1655.6 |
| A4 | SEQ ID NO: 4 | $C_{219}H_{343}N_{51}O_{72}S$ | 4874.5 | 1625.83 | 1626.8 |
| A5 | SEQ ID NO: 5 | $C_{219}H_{344}N_{54}O_{72}S$ | 4917.53 | 1640.18 | 1641.1 |
| A6 | SEQ ID NO: 6 | $C_{220}H_{348}N_{54}O_{70}S$ | 4901.57 | 1634.86 | 1637 |
| A7 | SEQ ID NO: 7 | $C_{215}H_{337}N_{53}O_{67}S$ | 4768.43 | 1591 | 1591 |
| A8 | SEQ ID NO: 8 | $C_{213}H_{333}N_{53}O_{67}S$ | 4740.37 | 1582.3 | 1582.3 |
| A9 | SEQ ID NO: 9 | $C_{221}H_{348}N_{54}O_{70}S$ | 4913.58 | 1641 | 1641 |
| A10 | SEQ ID NO: 10 | $C_{219}H_{344}N_{54}O_{70}S$ | 4885.53 | 1630.9 | 1630.9 |
| A11 | SEQ ID NO: 11 | $C_{222}H_{352}N_{54}O_{70}S$ | 4929.63 | 1646.2 | 1646.2 |
| A12 | SEQ ID NO: 12 | $C_{220}H_{348}N_{54}O_{70}S$ | 4901.57 | 1635.8 | 1635.8 |
| A13 | SEQ ID NO: 13 | $C_{216}H_{339}N_{53}O_{67}$ | 4750.39 | 1584.46 | 1586.1 |
| A14 | SEQ ID NO: 14 | $C_{219}H_{336}N_{52}O_{68}$ | 4785.39 | 1596.13 | 1596.4 |
| A15 | SEQ ID NO: 15 | $C_{219}H_{337}N_{53}O_{68}$ | 4800.41 | 1601.14 | 1602.3 |
| A16 | SEQ ID NO: 16 | $C_{215}H_{336}N_{54}O_{68}$ | 4765.36 | 1589.45 | 1590.9 |
| A17 | SEQ ID NO: 17 | $C_{219}H_{338}N_{52}O_{67}S$ | 4803.47 | 1602.16 | 1603.1 |
| A18 | SEQ ID NO: 18 | $C_{215}H_{336}N_{52}O_{68}S$ | 4769.41 | 1590.8 | 1592.5 |
| A19 | SEQ ID NO: 19 | $C_{216}H_{34}N_{53}O_{66}S$ | 4768.47 | 1590.49 | 1592.5 |
| A20 | SEQ ID NO: 20 | $C_{213}H_{334}N_{52}O_{67}S$ | 4727.37 | 1576.79 | 1578 |
| A21 | SEQ ID NO: 21 | $C_{222}H_{350}N_{54}O_{70}S$ | 4927.61 | 1643.54 | 1644.5 |
| A22 | SEQ ID NO: 22 | $C_{223}H_{352}N_{54}O_{70}S$ | 4941.64 | 1648.21 | 1649.2 |
| A23 | SEQ ID NO: 23 | $C_{223}H_{352}N_{54}O_{70}S$ | 4941.64 | 1648.21 | 1649.2 |
| A24 | SEQ ID NO: 24 | $C_{224}H_{351}N_{55}O_{73}S$ | 5014.64 | 1672.55 | 1679.2 |
| A25 | SEQ ID NO: 25 | $C_{224}H_{351}N_{55}O_{73}S$ | 5014.64 | 1672.55 | 1674.3 |
| A26 | SEQ ID NO: 26 | $C_{225}H_{355}N_{55}O_{73}S$ | 5030.69 | 1677.9 | 1673.6 |
| A27 | SEQ ID NO: 27 | $C_{223}H_{346}N_{54}O_{69}$ | 4887.53 | 1630.18 | 1631.8 |
| A28 | SEQ ID NO: 28 | $C_{223}H_{346}N_{54}O_{70}$ | 4903.53 | 1635.51 | 1637.2 |
| A29 | SEQ ID NO: 29 | $C_{226}H_{353}N_{55}O_{69}$ | 4944.63 | 1649.21 | 1650.3 |
| A30 | SEQ ID NO: 30 | $C_{225}H_{349}N_{55}O_{70}$ | 4944.58 | 1649.19 | 1650.1 |
| A31 | SEQ ID NO: 31 | $C_{229}H_{350}N_{54}O_{70}$ | 4979.63 | 1660.88 | 1662.4 |
| A32 | SEQ ID NO: 32 | $C_{224}H_{348}N_{54}O_{69}$ | 4901.56 | 1634.85 | 1635.9 |
| A33 | SEQ ID NO: 33 | $C_{226}H_{355}N_{55}O_{73}S$ | 5042.7 | 1681.9 | 1683.4 |
| A34 | SEQ ID NO: 34 | $C_{230}H_{362}N_{56}O_{76}S$ | 5159.8 | 1720.93 | 1722.1 |
| A35 | SEQ ID NO: 35 | $C_{232}H_{366}N_{56}O_{76}S$ | 5187.86 | 1730.29 | 1731.8 |
| A36 | SEQ ID NO: 36 | $C_{230}H_{362}N_{56}O_{76}S$ | 5159.8 | 1720.93 | 1722.1 |
| A37 | SEQ ID NO: 37 | $C_{232}H_{366}N_{56}O_{76}S$ | 5187.86 | 1730.29 | 1731.1 |
| A38 | SEQ ID NO: 38 | $C_{231}H_{366}N_{56}O_{76}S$ | 5175.85 | 1726.28 | 1727.5 |
| A39 | SEQ ID NO: 39 | $C_{224}H_{344}N_{54}O_{73}$ | 4961.52 | 1654.84 | 1641 |
| A40 | SEQ ID NO: 40 | $C_{228}H_{346}N_{54}O_{72}$ | 4995.58 | 1666.19 | 1667.8 |

TABLE 10-continued

Exemplary compounds: GLP-1 receptor agonist polypeptides

| Compound No. | SEQ ID NO: | Molecular Formula | Parent MW | Calculated Mass (M + 3/3) | Observed Mass (M + 3/3) |
|---|---|---|---|---|---|
| A41 | SEQ ID NO: 41 | $C_{224}H_{345}N_{55}O_{72}$ | 4960.54 | 1654.51 | 1655.8 |
| A42 | SEQ ID NO: 42 | $C_{225}H_{349}N_{55}O_{71}$ | 4960.58 | 1654.53 | 1655.7 |
| A43 | SEQ ID NO: 43 | $C_{223}H_{344}N_{54}O_{71}$ | 4917.51 | 1640.17 | 1641 |
| A44 | SEQ ID NO: 44 | $C_{225}H_{344}N_{56}O_{71}$ | 4969.55 | 1657.52 | 1658.9 |
| A45 | SEQ ID NO: 45 | $C_{225}H_{350}N_{54}O_{70}$ | 4931.58 | 1644.86 | 1646.4 |
| A46 | SEQ ID NO: 46 | $C_{227}H_{352}N_{54}O_{71}$ | 4973.62 | 1658.87 | 1660.1 |
| A47 | SEQ ID NO: 47 | $C_{226}H_{350}N_{54}O_{71}$ | 4959.59 | 1654.2 | 1655.8 |
| A48 | SEQ ID NO: 48 | $C_{221}H_{342}N_{52}O_{70}$ | 4847.46 | 1616.82 | 1618.3 |
| A49 | SEQ ID NO: 49 | $C_{221}H_{342}N_{54}O_{70}$ | 4875.48 | 1626.16 | 1626.7 |
| A50 | SEQ ID NO: 50 | $C_{223}H_{347}N_{55}O_{69}$ | 4902.55 | 1635.18 | 1636.8 |
| A51 | SEQ ID NO: 51 | $C_{226}H_{353}N_{55}O_{69}$ | 4944.63 | 1649.21 | 1650.7 |
| A52 | SEQ ID NO: 52 | $C_{226}H_{348}N_{56}O_{69}$ | 4953.59 | 1652.2 | 1653.3 |
| A53 | SEQ ID NO: 53 | $C_{226}H_{353}N_{57}O_{69}$ | 4972.64 | 1658.55 | 1660.1 |
| A54 | SEQ ID NO: 54 | $C_{226}H_{348}N_{54}O_{73}$ | 4989.58 | 1664.19 | 1665.3 |
| A55 | SEQ ID NO: 55 | $C_{226}H_{349}N_{55}O_{72}$ | 4988.59 | 1663.85 | 1665.4 |
| A56 | SEQ ID NO: 56 | $C_{225}H_{348}N_{54}O_{71}$ | 4945.57 | 1649.52 | 1650.6 |
| A57 | SEQ ID NO: 57 | $C_{228}H_{350}N_{56}O_{70}$ | 4995.63 | 1666.21 | 1667.8 |
| A58 | SEQ ID NO: 58 | $C_{227}H_{351}N_{53}O_{72}$ | 4974.6 | 1659.2 | 1660.5 |
| A59 | SEQ ID NO: 59 | $C_{229}H_{358}N_{54}O_{70}$ | 4987.69 | 1663.56 | 1664.4 |
| A60 | SEQ ID NO: 60 | $C_{226}H_{351}N_{53}O_{71}$ | 4946.59 | 1649.86 | 1650.7 |
| A61 | SEQ ID NO: 61 | $C_{225}H_{344}N_{56}O_{71}$ | 4969.55 | 1671.53 | 1659 |
| A62 | SEQ ID NO: 62 | $C_{226}H_{349}N_{57}O_{69}$ | 4968.61 | 1657.52 | 1658.4 |
| A63 | SEQ ID NO: 63 | $C_{228}H_{351}N_{57}O_{70}$ | 5010.65 | 1657.2 | 1672.7 |
| A64 | SEQ ID NO: 64 | $C_{225}H_{345}N_{57}O_{70}$ | 4968.56 | 1671.22 | 1658.4 |
| A65 | SEQ ID NO: 65 | $C_{237}H_{365}N_{57}O_{78}$ | 5260.85 | 1316.21 | 1317.4 |
| A66 | SEQ ID NO: 66 | $C_{234}H_{359}N_{57}O_{78}$ | 5218.77 | 1305.69 | 1306.5 |
| A67 | SEQ ID NO: 67 | $C_{234}H_{358}N_{56}O_{80}$ | 5235.75 | 1309.94 | 1311.3 |
| A68 | SEQ ID NO: 68 | $C_{233}H_{354}N_{56}O_{80}$ | 5219.71 | 1305.93 | 1306.5 |
| A69 | SEQ ID NO: 69 | $C_{231}H_{351}N_{55}O_{80}$ | 5178.65 | 1295.66 | 1296.7 |
| A70 | SEQ ID NO: 70 | $C_{233}H_{353}N_{55}O_{81}$ | 5220.69 | 1306.17 | 1307.2 |
| A71 | SEQ ID NO: 71 | $C_{231}H_{352}N_{56}O_{79}$ | 5177.67 | 1295.42 | 1296.7 |
| A72 | SEQ ID NO: 72 | $C_{232}H_{354}N_{56}O_{79}$ | 5191.7 | 1298.93 | 1299.7 |
| A73 | SEQ ID NO: 73 | $C_{233}H_{356}N_{56}O_{79}$ | 5205.72 | 1302.43 | 1303.1 |
| A74 | SEQ ID NO: 74 | $C_{226}H_{355}N_{55}O_{68}$ | 4930.64 | 1233.66 | 1234.6 |
| A75 | SEQ ID NO: 75 | $C_{231}H_{354}N_{54}O_{71}$ | 5023.68 | 1256.92 | 1256.9 |
| A76 | SEQ ID NO: 76 | $C_{224}H_{344}N_{54}O_{73}$ | 4961.52 | 1241.38 | 1243.1 |
| A77 | SEQ ID NO: 77 | $C_{223}H_{347}N_{55}O_{70}$ | 4918.54 | 1635.51 | 1641.8 |
| A78 | SEQ ID NO: 78 | $C_{224}H_{346}N_{54}O_{72}$ | 4947.54 | 1650.18 | 1650.8 |
| A79 | SEQ ID NO: 79 | $C_{232}H_{351}N_{55}O_{81}$ | 5206.66 | 1736.55 | 1737.9 |
| A80 | SEQ ID NO: 80 | $C_{233}H_{353}N_{55}O_{81}$ | 5220.69 | 1741.23 | 1742.9 |
| A81 | SEQ ID NO: 81 | $C_{234}H_{354}N_{56}O_{81}$ | 5247.72 | 1750.24 | 1751.5 |
| A82 | SEQ ID NO: 82 | $C_{233}H_{352}N_{56}O_{81}$ | 5233.69 | 1745.56 | 1747.8 |
| A83 | SEQ ID NO: 83 | $C_{234}H_{354}N_{56}O_{81}$ | 5247.72 | 1750.24 | 1751.5 |
| A84 | SEQ ID NO: 84 | $C_{232}H_{351}N_{55}O_{81}$ | 5206.66 | 1736.55 | 1737.6 |
| A85 | SEQ ID NO: 85 | $C_{222}H_{344}N_{54}O_{70}$ | 4889.5 | 1630.83 | 1631.8 |
| A86 | SEQ ID NO: 86 | $C_{223}H_{346}N_{54}O_{70}$ | 4903.53 | 1635.51 | 1637 |
| A87 | SEQ ID NO: 87 | $C_{223}H_{345}N_{55}O_{70}$ | 4930.56 | 1644.52 | 1646.2 |
| A88 | SEQ ID NO: 88 | $C_{223}H_{345}N_{55}O_{70}$ | 4916.53 | 1639.84 | 1641.2 |
| A89 | SEQ ID NO: 89 | $C_{224}H_{347}N_{55}O_{70}$ | 4930.56 | 1644.52 | 1646.2 |
| A90 | SEQ ID NO: 90 | $C_{225}H_{351}N_{55}O_{70}$ | 4943.56 | 1649.87 | 1650.8 |
| A91 | SEQ ID NO: 91 | $C_{224}H_{351}N_{55}O_{68}$ | 4899.57 | 1635.2 | 1637 |
| A92 | SEQ ID NO: 92 | $C_{232}H_{359}N_{55}O_{69}$ | 5019.63 | 1675.25 | 1676.6 |
| A93 | SEQ ID NO: 93 | $C_{230}H_{355}N_{55}O_{69}$ | 4991.6 | 1665.9 | 1667.6 |
| A94 | SEQ ID NO: 94 | $C_{229}H_{351}N_{55}O_{71}$ | 5007.55 | 1671.21 | 1672.9 |
| A95 | SEQ ID NO: 95 | $C_{228}H_{346}N_{52}O_{73}$ | 4980.5 | 1662.19 | 1663.8 |
| A96 | SEQ ID NO: 96 | $C_{224}H_{347}N_{55}O_{71}$ | 4946.55 | 1649.85 | 1650.8 |
| A97 | SEQ ID NO: 97 | $C_{222}H_{335}N_{53}O_{70}$ | 4866.42 | 1623.14 | 1624.2 |
| A98 | SEQ ID NO: 98 | $C_{217}H_{336}N_{54}O_{67}$ | 4773.39 | 1592.13 | 1593.3 |
| A99 | SEQ ID NO: 99 | $C_{217}H_{336}N_{54}O_{68}$ | 4789.39 | 1597.46 | 1599 |
| A100 | SEQ ID NO: 100 | $C_{216}H_{332}N_{54}O_{68}$ | 4773.34 | 1592.11 | 1593.3 |
| A101 | SEQ ID NO: 101 | $C_{222}H_{336}N_{54}O_{69}$ | 4865.44 | 1622.81 | 1624 |
| A102 | SEQ ID NO: 102 | $C_{216}H_{332}N_{54}O_{69}$ | 4789.34 | 1597.45 | 1599.1 |
| A103 | SEQ ID NO: 103 | $C_{222}H_{341}N_{55}O_{72}$ | 4932.48 | 1645.16 | 1646.7 |
| A104 | SEQ ID NO: 104 | $C_{224}H_{345}N_{55}O_{72}$ | 4960.54 | 1654.51 | 1656 |
| A105 | SEQ ID NO: 105 | $C_{226}H_{349}N_{55}O_{72}$ | 4988.59 | 1663.86 | 1665.3 |
| A106 | SEQ ID NO: 106 | $C_{224}H_{345}N_{55}O_{72}$ | 4960.54 | 1654.51 | 1655.7 |
| A107 | SEQ ID NO: 107 | $C_{223}H_{343}N_{55}O_{72}$ | 4946.51 | 1649.84 | 1650.9 |
| A108 | SEQ ID NO: 108 | $C_{225}H_{347}N_{55}O_{72}$ | 4974.56 | 1659.19 | 1660.7 |
| A109 | SEQ ID NO: 109 | $C_{227}H_{350}N_{56}O_{72}$ | 5015.62 | 1672.87 | 1674.2 |
| A110 | SEQ ID NO: 110 | $C_{225}H_{346}N_{56}O_{72}$ | 4987.56 | 1663.52 | 1664.4 |
| A111 | SEQ ID NO: 111 | $C_{223}H_{347}N_{55}O_{70}$ | 4918.54 | 1640.51 | 1641.7 |
| A112 | SEQ ID NO: 112 | $C_{224}H_{348}N_{56}O_{70}$ | 4945.57 | 1649.52 | 1649.9 |
| A113 | SEQ ID NO: 113 | $C_{224}H_{348}N_{56}O_{70}$ | 4945.57 | 1649.52 | 1650.8 |
| A114 | SEQ ID NO: 114 | $C_{223}H_{346}N_{56}O_{70}$ | 4931.54 | 1644.85 | 1646.3 |

TABLE 10-continued

Exemplary compounds: GLP-1 receptor agonist polypeptides

| Compound No. | SEQ ID NO: | Molecular Formula | Parent MW | Calculated Mass (M + 3/3) | Observed Mass (M + 3/3) |
|---|---|---|---|---|---|
| A115 | SEQ ID NO: 115 | $C_{222}H_{345}N_{55}O_{70}$ | 4904.52 | 1635.84 | 1637 |
| A116 | SEQ ID NO: 116 | $C_{229}H_{347}N_{55}O_{73}$ | 5038.61 | 1680.54 | 1681.8 |
| A117 | SEQ ID NO: 117 | $C_{223}H_{345}N_{55}O_{69}$ | 4900.53 | 1634.51 | 1636.9 |
| A118 | SEQ ID NO: 118 | $C_{223}H_{345}N_{55}O_{69}$ | 4900.53 | 1634.51 | 1635.9 |
| A119 | SEQ ID NO: 119 | $C_{224}H_{346}N_{54}O_{70}$ | 4915.54 | 1639.51 | 1641.3 |
| A120 | SEQ ID NO: 120 | $C_{225}H_{347}N_{53}O_{70}$ | 4914.55 | 1639.18 | 1641.2 |
| A121 | SEQ ID NO: 121 | $C_{225}H_{347}N_{53}O_{70}$ | 4914.55 | 1639.18 | 1641.2 |
| A122 | SEQ ID NO: 122 | $C_{220}H_{346}N_{54}O_{71}S$ | 4915.56 | 1639.52 | 1641.2 |
| A123 | SEQ ID NO: 123 | $C_{223}H_{341}N_{51}O_{74}$ | 4920.46 | 1641.15 | 1642 |
| A124 | SEQ ID NO: 124 | $C_{219}H_{341}N_{51}O_{73}S$ | 4888.48 | 1630.49 | 1632.2 |
| A125 | SEQ ID NO: 125 | $C_{220}H_{344}N_{54}O_{73}S$ | 4945.54 | 1649.51 | 1650.8 |
| A126 | SEQ ID NO: 126 | $C_{223}H_{339}N_{51}O_{73}$ | 4902.45 | 1635.15 | 1637 |
| A127 | SEQ ID NO: 127 | $C_{222}H_{340}N_{52}O_{71}$ | 4873.46 | 1625.49 | 1625.7 |
| A128 | SEQ ID NO: 128 | $C_{228}H_{344}N_{52}O_{72}$ | 4965.55 | 1656.18 | 1657.7 |
| A129 | SEQ ID NO: 129 | $C_{231}H_{351}N_{53}O_{72}$ | 5022.65 | 1675.22 | 1676.8 |
| A130 | SEQ ID NO: 130 | $C_{224}H_{341}N_{51}O_{73}$ | 4916.48 | 1639.83 | 1641.2 |
| A131 | SEQ ID NO: 131 | $C_{223}H_{342}N_{52}O_{71}$ | 4887.48 | 1630.16 | 1631.8 |
| A132 | SEQ ID NO: 132 | $C_{224}H_{349}N_{55}O_{70}$ | 4932.57 | 1645.19 | 1646.5 |
| A133 | SEQ ID NO: 133 | $C_{224}H_{346}N_{54}O_{72}$ | 4947.54 | 1650.18 | 1651 |
| A134 | SEQ ID NO: 134 | $C_{225}H_{351}N_{55}O_{70}$ | 4946.6 | 1649.87 | 1650.8 |
| A135 | SEQ ID NO: 135 | $C_{226}H_{349}N_{53}O_{70}$ | 4928.58 | 1643.86 | 1645.3 |
| A136 | SEQ ID NO: 136 | $C_{226}H_{347}N_{52}O_{72}$ | 4944.52 | 1649.17 | 1650.1 |
| A137 | SEQ ID NO: 137 | $C_{224}H_{345}N_{53}O_{70}$ | 4900.53 | 1634.51 | 1636 |
| A138 | SEQ ID NO: 138 | $C_{225}H_{347}N_{53}O_{70}$ | 4914.55 | 1639.18 | 1641 |
| A139 | SEQ ID NO: 139 | $C_{223}H_{347}N_{55}O_{70}$ | 4918.54 | 1640.51 | 1642 |
| A140 | SEQ ID NO: 140 | $C_{227}H_{351}N_{53}O_{70}$ | 4942.61 | 1648.54 | 1649.8 |
| A141 | SEQ ID NO: 141 | $C_{222}H_{343}N_{55}O_{69}$ | 4886.5 | 1629.83 | 1631 |
| A142 | SEQ ID NO: 142 | $C_{227}H_{353}N_{55}O_{71}$ | 4988.64 | 1248.16 | 1248.9 |
| A143 | SEQ ID NO: 143 | $C_{237}H_{366}N_{56}O_{77}$ | 5231.85 | 1308.96 | 1309.9 |
| A144 | SEQ ID NO: 144 | $C_{233}H_{360}N_{56}O_{76}$ | 5161.76 | 1291.44 | 1292.6 |
| A145 | SEQ ID NO: 145 | $C_{240}H_{368}N_{58}O_{76}$ | 5281.91 | 1321.48 | 1323.4 |
| A146 | SEQ ID NO: 146 | $C_{235}H_{362}N_{56}O_{77}$ | 5203.8 | 1301.95 | 1302.9 |
| A147 | SEQ ID NO: 147 | $C_{234}H_{358}N_{56}O_{79}$ | 5219.75 | 1305.94 | 1307 |
| A148 | SEQ ID NO: 148 | $C_{235}H_{363}N_{57}O_{77}$ | 5218.81 | 1305.7 | 1306.5 |
| A149 | SEQ ID NO: 149 | $C_{238}H_{364}N_{58}O_{76}$ | 5253.86 | 1314.47 | 1315.9 |
| A150 | SEQ ID NO: 150 | $C_{238}H_{365}N_{59}O_{76}$ | 5268.88 | 1318.22 | 1320.1 |
| A151 | SEQ ID NO: 151 | $C_{235}H_{362}N_{58}O_{73}$ | 5167.81 | 1292.95 | 1294 |
| A152 | SEQ ID NO: 152 | $C_{229}H_{350}N_{56}O_{72}$ | 5039.64 | 1260.91 | 1262.3 |
| A153 | SEQ ID NO: 153 | $C_{229}H_{351}N_{57}O_{71}$ | 5038.66 | 1260.67 | 1262.5 |
| A154 | SEQ ID NO: 154 | $C_{237}H_{360}N_{58}O_{78}$ | 5269.82 | 1318.46 | 1319.8 |
| A155 | SEQ ID NO: 155 | $C_{237}H_{361}N_{59}O_{77}$ | 5268.83 | 1318.21 | 1319.1 |
| A156 | SEQ ID NO: 156 | $C_{238}H_{366}N_{58}O_{75}$ | 5239.88 | 1310.97 | 1312.3 |
| A157 | SEQ ID NO: 157 | $C_{222}H_{342}N_{54}O_{72}$ | 4919.48 | 1230.87 | 1232.2 |
| A158 | SEQ ID NO: 158 | $C_{225}H_{351}N_{55}O_{70}$ | 4946.6 | 1237.65 | 1239.3 |
| A159 | SEQ ID NO: 159 | $C_{230}H_{347}N_{55}O_{81}$ | 5178.61 | 1295.65 | 1296.8 |
| A160 | SEQ ID NO: 160 | $C_{231}H_{351}N_{55}O_{79}$ | 5162.66 | 1291.67 | 1293 |
| A161 | SEQ ID NO: 161 | $C_{234}H_{357}N_{55}O_{79}$ | 5204.74 | 1302.19 | 1303.1 |
| A162 | SEQ ID NO: 162 | $C_{222}H_{345}N_{53}O_{68}$ | 5414.51 | 1617.6 | 1617.6 |

Example 3: Stability of Long Acting GLP-1 Receptor Agonist Polypeptides

Several long acting GLP-1 receptor agonist polypeptides described herein were tested, as the trifluoro acetate salt, for stability in DMSO (i.e., organosulfur solvent) or in aqueous (i.e., in DI water) at 1 mg/ml solution. These analog polypeptides were incubated at 37° C., and samples were withdrawn at various time intervals and analyzed by LC/MS and HPLC for determination of purity and mass of the parent peptide and extent of any degradation products. The purity results of these analyses are shown in Table 11 and are considered indicative of stability.

TABLE 11

Stability of long acting GLP-1 receptor agonist polypeptides

| Compound #, as its TFA salt unless indicated otherwise | Solute | Stability @ RT (% purity) Day 0 | Day 14 | Day 28 | Stability @ 37° C. (% purity) Day 14 | Day 28 |
|---|---|---|---|---|---|---|
| A36 | DI H$_2$O | 89.8 | 88 | 87.1 | 85.1 | 78 |
| A36 | Saline | 88.2 (c) | 94.5 | 85.7 | 80.4 | 75.5 (p) |
| A54 | DI H$_2$O | 98.4 | 90.4 | 97 | 92.6 | 87 |
| A54 | Saline | 98.2 | 97.2 | 97.3 | 94.3 | 88.9 |
| A55 (acetate salt) | DI H$_2$O | 93.6 | — | — | — | — |
| A55 (acetate salt) | Saline | 98.3 | — | — | — | — |
| A162 | DI H$_2$O | 95.8 | 94.7 | 94.5 | 96.6 | — |
| A162 | Saline | 97.9 | 93.7 | 94.9 | 96.7 | 85.5 (c) |
| A152 | DI H$_2$O | 90.6 | 90.7 | 91.7 | 96.4 | 90.6 |
| A152 | Saline | 91.2 | 89.6 | 90.7 | 85.2 | 83.8 |
| A154 | DI H$_2$O | 96.9 | 96.1 | 94.7 | 92.6 | — |

TABLE 11-continued

Stability of long acting GLP-1 receptor agonist polypeptides

| Compound #, as its TFA salt unless indicated otherwise | Solute | Stability @ RT (% purity) Day 0 | Day 14 | Day 28 | Stability @ 37° C. (% purity) Day 14 | Day 28 |
|---|---|---|---|---|---|---|
| A154 | Saline | 94 | 97 | 92.4 | 92.8 | — |
| A68 | DI H₂O | 97.4 | 94.2 | 93.7 | 98.4 (p) | |
| A68 | Saline | 96 (p) | 95.2 | 95.2 | 94.9 | — |
| A72 | DI H₂O | 98.9 | 96.2 | 95.1 | N/A | — |
| A72 | Saline | 98.5 | 97.4 | — | 98.7 | — |
| A80 | DI H₂O | 95.8 (c) | 91.9 | 90.3 | 94.6 | (p) |
| A80 | Saline | 96.6 (p) | 95.2 | 91.9 | 90.9 | (p) |
| A87 | DI H₂O | 96.6 | 94.4 | 90.1 | 91 | |
| A87 | Saline | 97.5 | 91.6 | 89.6 | 83.9 | — |
| A88 | DI H₂O | 96.9 | 94.6 | 93 | 97.5 | — |
| A88 | Saline | 97.2 | 93.6 | 92.1 | 95 | — |
| A96 | DI H₂O | 99.1 | 97.7 | 97.6 | 96.1 | — |
| A96 | Saline | 98.1 | 96.3 | 96.1 | 93.2 | — |
| A103 | DI H₂O | 83.6 | 89.4 | 88.2 | 91 | — |
| A103 | Saline | 78.9 | 86.4 | 86 | 94.9 | — |
| A107 | DI H₂O | 99.5 | 97.4 | 97 | 92.7 | — |
| A107 | Saline | 97.5 | 93.5 | 94.3 | 96.8 | — |
| A111 | DI H₂O | 99 | 96.4 | 96.2 | 91.9 | — |
| A111 | Saline | 98.3 | 91.7 | 92.7 | 95.7 | — |
| A112 | DI H₂O | 98.2 | 96.1 | 97.9 | 92.9 | — |
| A112 | Saline | 98.4 | 97.5 | 96.5 | 92.2 | — |
| A114 | DI H₂O | 98.3 | 95.7 | 97.5 | 95.4 | — |
| A114 | Saline | 97.5 | 95.2 | 95.2 | 95.5 | — |
| A115 | DI H₂O | 98.5 | 97.4 | 96.6 | 94.5 | — |
| A115 | Saline | 98.5 | 96.9 | 96 | 94.3 | — |
| A120 (acetate salt) | DI H₂O | 96.7 | — | — | — | — |
| A120 (acetate salt) | Saline | 98.5 | — | — | — | — |
| A132 | DI H₂O | 98.6 | 96.4 | 96.3 | 94.4 | — |
| A132 | Saline | 98.5 | 93.6 | 96.3 | 93.4 | — |
| A134 | DI H₂O | 98 | 94.5 | 96.8 | — | — |
| A134 | Saline | 99 | 92.7 | — | 96.1 | — |
| A139 | DI H₂O | 99.2 | 95.4 | 97.3 | — | — |
| A139 | Saline | 97.5 | 95.1 | 96.9 | 97 | — |

(c) = cloudy;
(p) = particulates
"—" = not determined

Example 4: Solubility of Long Acting GLP-1 Receptor Agonist Polypeptides

Certain long acting GLP-1 receptor agonist polypeptides described herein were tested for solubility in saline or in DI water at room temperature. Samples were visually inspected for clarity of the sample, and any appearance of turbidity or haziness. The results of these analyses are shown in Table 12.

TABLE 12

Solubility of long acting GLP-1 receptor agonist polypeptides

| Compound #, as its TFA salt unless indicated otherwise | Solubility (mg/mL) in DI water | Solubility (mg/mL) in saline |
|---|---|---|
| A36 | >80 | >51 |
| A55 (acetate salt) | >31 | >36 |
| A54 | >94 | >149 |
| A162 | >101 | >101 |
| A152 | >109 | >101 |
| A154 | >70 | >106 |
| A68 | >53 | >117 |
| A80 | >78 | >75 |
| A87 | >88 | >104 |
| A88 | >81 | >107 |
| A96 | >128 | >133 |
| A103 | >62 | >180 |
| A107 | >98 | >148 |
| A111 | >165 | >164 |
| A112 | >122 | >179 |
| A114 | >93 | >127 |
| A115 | >143 | >146 |
| A120 (acetate salt) | >18 | >56 |
| A132 | >192 | >138 |
| A134 | >61 | >134 |
| A139 | >108 | >183 |

Example 5: Functional Assays of Long Acting GLP-1 Receptor Agonist Polypeptides: Human and Rat Receptors (GLP-IRs)

Activation of the human and rat GLP-1 receptors (GLP-1R), leads to increases in cellular cyclic adenosine monophosphate (cAMP). In the presence of the non-specific cAMP/cGMP phosphodiesterase inhibitor, 3-isobutyl-1-methylxanthine (IBMX), accumulating cAMP can be measured in vitro using common detection methods. Thus, it is possible to estimate an in vitro potency (pEC50) for peptides activating each of these receptors using fit dose-response curves for cAMP accumulation.

Cell Handling and cAMP Accumulation Assays

CHO-K1 cells stably expressing human GLP-1R (Genebank accession #NM_002062) were grown in 90% F12-K media supplemented with 10% FBS and 250 µg/ml G418. For rat GLP-1R expression, a cDNA fragment encoding the full-length open reading frame of the rat GLP-1R (Genebank accession #NM 012728) was sub-cloned into the expression vector pcDNA3.1+ to enable transient receptor expression in CHO-K1 cells.

On day 1, CHO-K1 cells were plated at 1.5 million cells per T75 flask in 90% F12-K media supplemented with 10% FBS. On day 3 cells were transfected with 40 mcg of the rat GLP1R expression plasmid using Lipofectamine 2000 transfection reagent. On day 5, human or rat GLP-1R expressing cells were dispensed at 1000 cells per well in white 384-well OptiPlates in 5 mcL of assay buffer consisting of 1×HBSS, 5 mM HEPES, 0.5 mM IBMX, and 0.1% casein.

Peptides were serially diluted 4-fold in assay buffer to final concentrations ranging from $1\times10^{-9}$ M to $9.5\times10^{-16}$ M. Two assay controls consisting of 50 mcM forskolin (cAMP system maximum) or assay buffer only (cAMP system minimum) were also prepared. Five microliters of each peptide-concentration, or assay control, was added to triplicate wells and incubated for thirty minutes at room temperature. During this incubation step a 4× europium labelled cAMP tracer solution and a 4× Ulight®-anti-cAMP solution (consisting of an anti-cAMP monoclonal antibody labelled with Ulight™ dye) was prepared according to the manufacturer's protocol (PerkinElmer LANCE Ultra cAMP kit). Following this incubation, 5 mcL europium labelled cAMP and 5 mcL Ulight anti-cAMP antibody was added to each well. The plate was covered to prevent evaporation and incubated for 60 minutes at room temperature in the dark. Plates were read on an Envision fluorescent plate reader (PerkinElmer).

Data Analysis

Test values were first normalized to the system maximum and system minimum averaged values in Excel using the formula: (test value−system min average)/(system max average−system min average)*100. Normalized test values represent a baseline corrected percentage of the system maximum cAMP response induced by forskolin. Data from up to 3 replicate tests were analyzed for each peptide. Potency values were estimated using GraphPad Prism software (v7.04) by fitting data to a 4-parameter logistic curve model: Y=Bottom+(Top−Bottom)/(1+10^((Log EC50−X))). The Hill slope was constrained to 1.0. EC50 values were converted to pEC50 values using the formula: pEC50=−Log (EC50). Mean pEC50 values and 95% confidence intervals are reported in Table 13.

TABLE 13

Mean pEC50 values on hGLP-1R and rGLP-1R

| Compound # | hGLP-1R pEC50 (0.1% casein) | rGLP-1R pEC50 (0.1% casein) |
|---|---|---|
| GLP-1 (7-36) | 12.1 | 11.9 |
| exenatide | 12.1 | 12.0 |
| A120 | 12.2 | 11.9 |
| A55 | 12.0 | 11.8 |
| A115 | 12.3 | 12.0 |
| A132 | 12.1 | 11.6 |
| A77 | 12.3 | 12.1 |
| A108 | 12.0 | 11.9 |
| A134 | 12.0 | 11.6 |
| A45 | 11.7 | 11.6 |
| A139 | 12.1 | 11.7 |
| A114 | 12.2 | 12.0 |
| A112 | 12.1 | 11.9 |
| A46 | 11.9 | — |
| A54 | 12.0 | 11.9 |
| A78 | 11.9 | 11.9 |
| A111 | 12.1 | 11.8 |
| A6 | 12.0 | 11.8 |
| A68 | 12.2 | 12.2 |
| A107 | 12.3 | 11.9 |
| A89 | 12.1 | 11.7 |
| A94 | 12.2 | — |
| A70 | 12.1 | 11.7 |
| A103 | 12.2 | 11.8 |
| A71 | 12.1 | 11.9 |
| A147 | 12.1 | 11.7 |
| A74 | 12.0 | 11.5 |
| A149 | 11.9 | 11.7 |
| A86 | 12.1 | 11.7 |
| A85 | 12.1 | 11.8 |
| A87 | 12.0 | 11.6 |
| A88 | 12.0 | 11.6 |
| A63 | 11.7 | 11.8 |
| A92 | 11.7 | — |
| A75 | 11.7 | 11.4 |

"—" = not determined

Example 6: Intravenous Infusion of Long Acting GLP-1 Receptor Agonist Polypeptides: Studies to Assess Intravenous Pharmacokinetics of Polypeptides Peptides were dissolved in 0.05% TWEEN-20® (polysorbate 20) in phosphate buffered saline and administered as a 1-hour intravenous infusion to non-fasted male Sprague-Dawley rats (n=3 per group) via femoral vein cannula at a final dose of 0.033 mg/kg. Formulations were administered at a rate of 1.67 mL/kg/h. Blood samples (approximately 250 µL) were collected for pharmacokinetic analysis via a jugular vein cannula at 0.25, 0.5, 0.75, 1, 1.17, 1.33, 1.5, 2, 4, 8, 24, 48, 72, and 96 hours post-start of infusion into microtainer tubes containing $K_2EDTA$ as anticoagulant and 25 µL of a protease inhibitor cocktail. Plasma was prepared by centrifugation and stored at −80° C. until analysis. The results of this analysis are shown in Table 14.

Example 7: Subcutaneous Bolus Injection of Long Acting GLP-1 Receptor Agonist Polypeptides: Studies to Assess Bioavailability of Polypeptides Peptides were dissolved in 0.05% TWEEN-20® (polysorbate 20) in phosphate buffered saline and administered to non-fasted male Sprague-Dawley rats (n=3 per group) at a dose of 0.100 mg/kg via a single bolus injection into the subcutaneous space between the scapulae. Blood samples (approximately 250 µL) were collected for pharmacokinetic analysis via a jugular vein cannula at 0.083, 0.25, 0.5, 1, 2, 4, 8, 24, 48, 72, and 96 hours post-dose into microtainer tubes containing $K_2EDTA$ as anticoagulant and 25 µL of a protease inhibitor cocktail. Plasma was prepared by centrifugation and stored at −80° C. until analysis. The results of this analysis are also shown in Table 14.

TABLE 14

Pharmacokinetic analyses

| Compound # | CL mg/min/Kg | $T_{1/2}$ (IV) hrs | % F (SC Bolus) |
|---|---|---|---|
| A120 | 0.054 | 15.8 | 92.9 |
| A55 | 0.054 | 14.7 | 62.6 |
| A115 | 0.058 | 16.7 | 63.4 |
| A132 | 0.048 | 9.7 | 41.7 |
| A77 | 0.086 | 12.9 | 55.7 |
| A108 | 0.061 | 13.7 | 58.6 |
| A134 | 0.108 | 7.91 | 45.3 |
| A45 | 0.054 | 13.3 | 24.0 |
| A139 | 0.092 | 20.9 | 58.1 |
| A114 | 0.061 | 16.0 | 44.2 |
| A112 | 0.041 | 10.8 | 39.5 |
| A46 | 0.057 | 17.0 | 23.0 |
| A54 | 0.057 | 15.6 | 58.4 |
| A78 | 0.077 | 11.0 | 52.1 |
| A111 | 0.075 | 13.6 | 59.9 |
| A6 | 0.148 | 9.81 | 45.0 |
| A68 | 0.100 | 17.1 | 75.2 |
| A107 | 0.165 | 13.5 | — |
| A89 | 0.102 | 13.5 | — |
| A94 | 0.060 | 20.3 | — |
| A70 | 0.092 | 18.4 | — |
| A103 | 0.131 | 16.8 | — |
| A71 | 0.098 | 18.5 | — |
| A147 | 0.056 | 18.3 | — |
| A74 | 0.152 | 8.04 | — |

"—" = not determined

Example 8: Method of Plasma Sample Preparation for Pharmacokinetic Studies

Protein Precipitation

A 60 µL aliquot of each plasma sample was placed into to an Impact Protein Precipitation 96-well filter plate (Phenomenex, Torrance, CA). To each well was added 6 µL of 0.5% TWEEN-20 ® (polysorbate 20). Plates were then vortexed mixed for 10 minutes at 1200 rpm before 180 µL of 0.1% TFA in 2:1 ethanol:acetonitrile containing an appropriate internal standard was added to each well. Plates were vortex mixed for 5 min at 1400 rpm, and then centrifuged for 10 min at 500×g. Filtrates were evaporated under a nitrogen stream at 45° C. Residues were reconstituted in 80 µL of 20% acetonitrile (aq) containing 0.1% formic acid.

Example 9: LC/MS Quantification of Long Acting GLP-1 Receptor Agonist Polypeptides in Plasma All calibration standards were prepared in control rat plasma containing $K_2$EDTA and protease inhibitor cocktail. Samples and standards were analyzed by TurboIonSpray™ UPLC-MS/MS using a system consisting of a CTC HTS PAL auto-injector (Leap, Carrboro, NC), an Agilent Infinity 1290 system with column oven (Palo Alto, CA), a Valco switching valve (Houston, TX), and either an AB Sciex API 5600 TripleTOF™ or Sciex API 4000QTrap mass spectrometer (Framingham, MA). Samples were injected onto a 2.1×50 mm reverse phase C18 analytical column, typically a Waters CORTECS UPLC C18+, 1.6 µm (Waters Corporation, Milford, MA) or similar. Chromatographic separation was achieved with a gradient method using water containing 0.1% formic acid (A) and acetonitrile containing 0.1% formic acid (B) as mobile phase. Initial conditions consisted of 90% A and 10% B. The organic component was increased to 95% B over a period of 2-3 minutes, depending on the peptide. Typical flow rates were 600 µL/min. The column temperature was held constant at 50° C. Peptides were quantified by monitoring one or more product ions produced from a multiply charged parent ion.

Example 10: In Vivo Efficacy of Long Acting GLP-1 Receptor Agonist Polypeptides on Food Intake Inhibition in Rats Acute food intake was measured continuously for a 96-hour period using a BioDAQ food monitoring system (Research Diets, New Brunswick, NJ) to determine the amount of food intake inhibition exhibited by these long acting GLP-1 receptor agonist polypeptides. Long Evans rats were obtained at approximately 8 weeks of age. The rats were singly housed and acclimated to 45% high fat diet for at least 2 weeks prior to dosing. After 1 week of acclimation all rats were singly housed in BioDAQ cages (Research Diets, New Brunswick, NJ) and maintained at constant temperature (approximately 22° C.) and 30-70% relative humidity with 12 hr light/dark cycle (lights on from 5:00 AM to 5:00 PM). The rats were given ad libitum access to water and pellet chow (Research Diets D12451i, 45 kcal % fat, Research Diets, New Brunswick, NJ). All procedures were performed in compliance with the Animal Welfare Act, USDA regulations and approved by the Mispro Institutional Animal Care and Use Committee. Animals were randomized into treatment groups according to body weight (n=8 rats/group). Animals were dosed (SC bolus injection) with either a long acting GLP-1 receptor agonist polypeptide (30 mcg/kg) or vehicle control (saline) and were dosed between 4:30 and 5:00 prior to lights out with hoppers gated while animals were being dosed. Hopper gates were opened, and continuous data collection started immediately following completion of dosing. Data was initially analyzed using the BioDAQ Viewer software (version 2.3.07) and bout filters were set if needed to reduce noise in data associated with nonfeeding behavior. All the data are expressed as % inhibition from vehicle control and summarized as mean. The data were analyzed for statistical significance with Microsoft Excel (Redmond, WA) by 2-sample t-test. P-values<0.05 were considered to indicate a significant difference between treatment groups. Acute % food intake inhibition from vehicle control results for the long acting GLP-1 receptor agonist polypeptides are shown in Table 15.

TABLE 15

Acute % food intake inhibition in rats after bolus SC dosing of LA GLP-1 analog polypeptides.

| Compound | Acute Food Intake Assay (30 mcg SC bolus) % Food Intake Inhibition from Vehicle | | | |
|---|---|---|---|---|
| # | 0-24 hr | 25-48 hr | 49-72 hr | 73-96 hr |
| A120 | −38.2 | −68.3 | −29.4 | 8.0 |
| A132 | −26.4 | −70.0 | −26.4 | −12.9 |
| A115 | −28.9 | −71.0 | −21.2 | 15.4 |
| A55 | −42.4 | −70.4 | −64.7 | −0.8 |
| A135 | −52.6 | −62.2 | −29.4 | −8.0 |
| A137 | −67.0 | −69.0 | −25.7 | −14.7 |
| A77 | −62.9 | −56.6 | −20.3 | −0.9 |
| A108 | −34.4 | −61.7 | −27.4 | −11.3 |
| A134 | −25.1 | −65.0 | −26.9 | −4.7 |
| A45 | −36.0 | −84.1 | −12.5 | −22.7 |
| A139 | −31.1 | −71.9 | −20.0 | −8.4 |
| A114 | −38.3 | −36.0 | −4.7 | 30.2 |
| A112 | −42.2 | −54.9 | −21.3 | 11.9 |
| A46 | −48.3 | −70.6 | −46.1 | −25.3 |
| A54 | −38.3 | −82.8 | −36.9 | −12.4 |
| A78 | −62.2 | −47.2 | −6.7 | −0.6 |
| A111 | −22.7 | −54.0 | −23.9 | −9.5 |
| A6 | −64.2 | −48.8 | −8.8 | 9.7 |
| A68 | −59.5 | −66.1 | −56.6 | −11.8 |
| A107 | −60.8 | −39.1 | −11.6 | 2.6 |
| A94 | −37.0 | −52.4 | −10.4 | 9.6 |
| A70 | −52.3 | −70.2 | −54.1 | −31.9 |
| A103 | −17.3 | −4.8 | 9.0 | 21.2 |
| A147 | −54.2 | −52.8 | −40.2 | 6.1 |
| A149 | −4.8 | −9.7 | −12.1 | 25.2 |
| A62 | −37.1 | −48.8 | −47.4 | 19.5 |

Bold = P < 0.05 vs. vehicle

Example 11: In Vivo Efficacy on Body Weight Changes in LE Rats after Bolus SC Dosing of Long Acting GLP-1 Receptor Agonist Polypeptides Body weights were measured on the same LE rats used for measuring food intake in Example 11 to investigate the efficacy and durability of the long acting GLP-1 receptor agonist polypeptides on weight loss after bolus SC dosing (30 mcg/kg). The data were analyzed in Excel and/or Prism (GraphPad Software, Inc., La Jolla, CA) using one-way ANOVA to compare each group to the appropriate control group. P-values<0.05 were considered to indicate a significant difference between treatment groups. The mean weight loss (%) from baseline and vehicle control (ΔΔ %) from the food intake studies are shown in Table 16.

TABLE 16

The mean weight loss (%) from baseline and vehicle control (ΔΔ %) from the food intake

| Compound | Weight Loss (30 mcg/kg SC bolus) % Weight change from Vehicle | | | | | |
|---|---|---|---|---|---|---|
| # | 1 d | 2 d | 3 d | 4 d | 5 d | 6 d |
| A120 | −4.6 | −7.6 | −6.9 | — | — | — |
| A132 | −4.7 | −9.1 | −8.9 | −6.3 | — | — |
| A115 | −4.5 | −6.9 | −6.2 | — | — | — |
| A55 | −3.5 | — | −8.6 | −7.0 | — | −5.5 |
| A135 | −4.3 | −7.4 | −6.4 | −4.2 | — | — |

TABLE 16-continued

The mean weight loss (%) from baseline and vehicle control (ΔΔ %) from the food intake

| Compound | Weight Loss (30 mcg/kg SC bolus) % Weight change from Vehicle | | | | | |
|---|---|---|---|---|---|---|
| # | 1 d | 2 d | 3 d | 4 d | 5 d | 6 d |
| A137 | -4.7 | -6.6 | -6.0 | -4.8 | — | — |
| A77 | -3.2 | -5.3 | -4.7 | -4.2 | — | — |
| A108 | -3.9 | -6.2 | -4.7 | -4.0 | — | — |
| A134 | -4.8 | -8.8 | -7.8 | -5.4 | — | — |
| A45 | -4.5 | — | -8.3 | — | — | -5.1 |
| A139 | -4.4 | -7.7 | -7.2 | -4.8 | — | — |
| A114 | -4.4 | -4.2 | -3.0 | — | — | — |
| A112 | -4.7 | -5.3 | -3.9 | — | — | — |
| A46 | -3.9 | -8.8 | -8.9 | -7.4 | -7.2 | — |
| A54 | -5.1 | -9.3 | -10.2 | — | — | — |
| A78 | -4.0 | -5.9 | -5.0 | -4.4 | — | — |
| A111 | -3.4 | -5.8 | -4.9 | -3.9 | — | — |
| A6 | -5.8 | — | -5.3 | — | — | -3.7 |
| A68 | -3.7 | -4.9 | -4.9 | — | -4.4 | -4.1 |
| A107 | -2.9 | -3.2 | -2.9 | -2.7 | — | — |
| A94 | -4.6 | -6.8 | -5.4 | — | — | — |
| A70 | -2.4 | -3.1 | -3.7 | — | -3.5 | — |
| A103 | -2.8 | -1.6 | -0.9 | — | — | — |
| A147 | -4.5 | -6.3 | -6.8 | -6.4 | -5.1 | — |
| A149 | -1.8 | -1.6 | -1.4 | -1.0 | — | — |
| A68 | -2.5 | — | -3.3 | -2.3 | — | -2.4 |

"—" not measured;
Bold P < 0.05 vs. vehicle

Example 12: Weight-Loss Efficacy of Long Acting GLP-1 Receptor Agonist Polypeptides in LE DIO Rats Weight loss efficacy studies were conducted in a rodent model for obesity Long Evans (LE) diet-induced obese (DIO) rat to investigate the efficacy and durability of the long acting GLP-1 receptor agonist polypeptides after bolus subcutaneous (SC) dosing. Male LE DIO rats were used (Envigo Laboratories, Inc., Indianapolis, IN) and beginning at weaning, the rats were fed a high fat chow (Teklad TD 95217, 40% kcal from fat, Harlan Laboratories, Madison, WI). Rats were 15-17 weeks old at the start of the study. The rats were housed 1 per cage and given ad libitum access to high fat diet (Harlan TD.95217, 4.3 kcal/g) and water, maintained on a 12 hr light/dark cycle from 5:00 AM to 5:00 PM at 21° C. and 50% relative humidity and allowed to acclimate for at least 10 days prior to use. Male LE DIO rats at 18 weeks of age (14 weeks on high fat diet) were dosed by bolus SC injection of the long acting GLP-1 receptor agonist polypeptides (30 mcg/kg; n=6 animals/treatment group). All other procedures were the same as described for previous example. The mean weight loss (%) from baseline and vehicle control (ΔΔ %) results are shown in Table 17.

TABLE 17

The mean weight loss (%) from baseline and vehicle control (ΔΔ %)

| Compound | DIO Weight Loss (30 mcg/kg SC bolus) % Weight change from Vehicle | | | | | |
|---|---|---|---|---|---|---|
| # | 1 d | 2 d | 3 d | 4 d | 5 d | 6 d |
| A120 | -0.4 | -3.7 | -5.9 | -6.0 | -4.9 | -4.6 |
| A132 | -0.7 | -2.5 | -4.5 | -3.7 | -2.0 | -1.6 |
| A115 | -0.6 | -2.7 | -4.4 | -3.2 | -1.9 | -1.4 |
| A55 | -0.6 | -3.4 | -6.0 | -6.5 | -4.9 | -4.2 |

TABLE 17-continued

The mean weight loss (%) from baseline and vehicle control (ΔΔ %)

| Compound | DIO Weight Loss (30 mcg/kg SC bolus) % Weight change from Vehicle | | | | | |
|---|---|---|---|---|---|---|
| # | 1 d | 2 d | 3 d | 4 d | 5 d | 6 d |
| A135 | — | -3.7 | -4.8 | -4.3 | — | — |
| A137 | — | -3.0 | -2.9 | -2.7 | — | — |
| A134 | -0.6 | -3.1 | -5.6 | -5.1 | -4.1 | -3.5 |
| A54 | -0.6 | -3.4 | -6.0 | -6.3 | -4.7 | -3.8 |

"—" not measured;
Bold P < 0.05 vs. vehicle

Example 13: Efficacy of Long Acting GLP-1 Receptor Agonist Polypeptides on Food Intake in LE DIO Rats Food intake was measured on the same LE DIO rats used for measuring body weights in Example 13 to investigate the efficacy and durability of the long acting GLP-1 receptor agonist polypeptides on food intake inhibition after bolus SC dosing (30 mcg/kg). Food hopper weights were measured daily. All other procedures were the same as described for the previous example. The results of mean reduction in food intake (%) from vehicle control (ΔΔ %) are shown in Table 18.

TABLE 18

The results of mean reduction in food intake (%) from vehicle control (ΔΔ %)

| Compound | DIO Food Intake (30 mcg/kg; SC bolus) % Food Intake Inhibition from Vehicle | | | | |
|---|---|---|---|---|---|
| # | 1 d | 2 d | 3 d | 4 d | 5d |
| A120 | -71.4 | -91.2 | -24.6 | -5.5 | 7.1 |
| A132 | -54.9 | -70.6 | -4.2 | 12.7 | -1.0 |
| A115 | -65.9 | -60.8 | 0.0 | 12.7 | 19.4 |
| A55 | -68.1 | -71.6 | -20.3 | 13.6 | 29.6 |
| A134 | -76.9 | -69.6 | -1.7 | 20.9 | 23.5 |
| A54 | -70.3 | -59.8 | -19.5 | 16.4 | 33.7 |

Bold = P < 0.05 vs. vehicle

Example 14: Chronic Weight Loss Efficacy of Long Acting GLP-1 Receptor Agonist Polypeptides in LE DIO Rats Chronic studies were conducted to determine the effects and durability of continuous administration of long acting GLP-1 receptor agonist polypeptides on body weight after 27 days of treatment in the LE DIO rat. Male LE DIO rats at 18 weeks of age (14 weeks on high fat diet) were treated the same as described for Example 13. The rats were weighed and fat and non-fat mass body composition measurements were made using quantitative magnetic resonance (QMR) (Echo Medical Systems, Houston, TX) per manufacturer's protocol before the start of drug treatment (Day -9) and on day 27. Body weights were measured throughout the study. The rats were randomized into treatment groups (n=8/group) with similar mean body weights and fat mass. The LE DIO rats were dosed by SC injection every other day (eod) with either long acting GLP-1 receptor agonist polypeptides or vehicle (saline). All other procedures were the same as described for the previous example. The mean weight loss (%) from baseline and vehicle control (ΔΔ %) results are shown in FIG. 1 and Table 19.

Example 15: Chronic Anti-Diabetic Efficacy of Long Acting GLP-1 Receptor Agonist Polypeptides in ZDF Rats Chronic studies were conducted to determine the antidiabetic effects of continuous administration of long acting GLP-1 receptor agonist polypeptides on HbA1c (a primary anti-diabetic parameter) after 27 days of treatment in Zucker Diabetic Fatty (ZDF) rats. Male ZDF rats were obtained at six (6) weeks of age (Charles River, Raleigh, NC) and used on study at eight (8) weeks old. Upon receipt, the rats were housed one animal per cage with free access to Purina 5008 chow (Lab Diet, St. Louis, MO) and water, maintained on a 12-hour light/dark cycle from 5:00 AM to 5:00 PM at 21° C. and 50% relative humidity and allowed to acclimate for nine (9) days before the start of the study. Blood samples were taken as pre-bleeds (Day−3) via tail vein to measure glucose levels and HbA1c. The ZDF rats were randomized into treatment groups (n=9-10/group) with similar mean HbA1c and glucose. Long acting GLP-1 receptor agonist polypeptides were dosed every other day (eod) by SC injection. Blood samples were taken again on Days 14 and 27 (end of study) to measure glucose levels and HbA1c. Final whole blood samples were collected by cardiac puncture under isoflurane anesthesia (Day 27). HbA1c analysis was performed by using a Carolina Chemistries CLC720i Clinical Chemistry analyzer (Mindray Inc., Mahwah, NY) with the protocol and method parameters as described by the manufacturer. HbA1c results expressed as the mean % change from baseline and vehicle control (ΔΔ %) are shown in Table 19.

TABLE 19

Summary of weight loss and HbA1c changes in rats treated with long acting GLP-1 receptor agonist polypeptides

| Compound # | DIO Dose Response 27 day weight loss | | ZDF Dose Response 27 day HbA1c (%) | |
|---|---|---|---|---|
| | ΔΔ % weight loss* | $ED_{50}$ (mcg/kg/d) | ΔΔ % HbA1c* | $ED_{50}$ (mcg/kg/d) |
| A120 | 14 | 14 | 2.7 | 7.4 |
| A115 | 15 | 17 | 2.8 | 8.2 |
| A55 | 10 | 4 | — | — |
| A45 | 16 | 11 | 1.8 | 7.2 |

"—" = not determined;
Bold = P < 0.05 vs. vehicle;
*% at the $ED_{50}$

Figure 3:
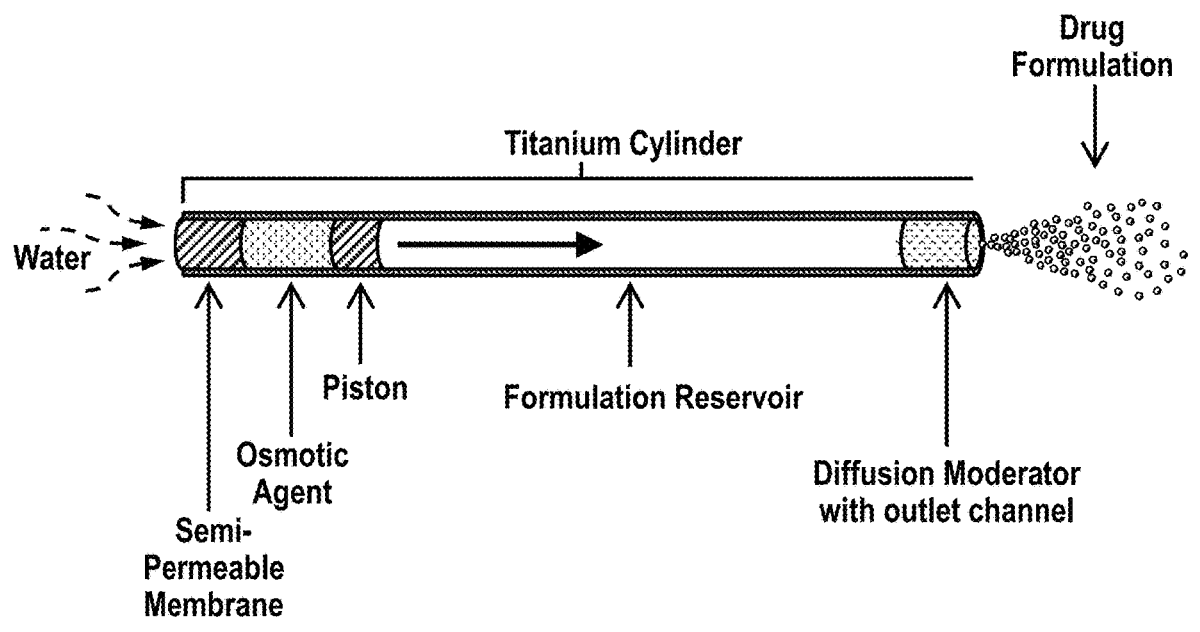

Example 16: Comparative Weight Loss & Antidiabetic Potencies of GLP-1 Receptor Agonist Polypeptides in ZDF Rats GLP-1 receptor agonist polypeptides can be administered to patients, in one embodiment, via an implantable drug delivery device. The Medici Drug Delivery System™ (Intarcia Therapeutics, Boston, MA) comprises an osmotic drug delivery mini-pump (illustrated in FIG. 3) for subdermal placement in a patient to provide subcutaneous delivery of a drug at a continuous rate for extended periods of time, such as 3, 6, 12, 18, or 24 months, etc. The osmotic drug delivery mini-pump of FIG. 3 is 44 mm long and 4 mm in diameter. It includes a drug reservoir having a constrained volume. As such, high in vivo potency is necessary for a drug to be amenable for delivery via this mini-pump.

Figure 2A:
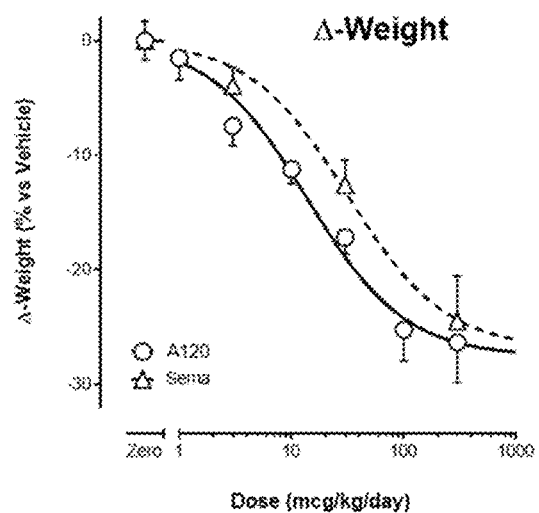
FIG. 2A illustrates comparative in vivo weight loss potencies in DIO rats for compound A120 vs semaglutide (% baseline vs vehicle over 28 days, n=6/dose). Ozempic® (semaglutide, Novo Nordisk A/S of Bagsvaerd. Denmark) has been approved by the U.S. FDA for the treatment of type 2 diabetes.
Figure 2B:
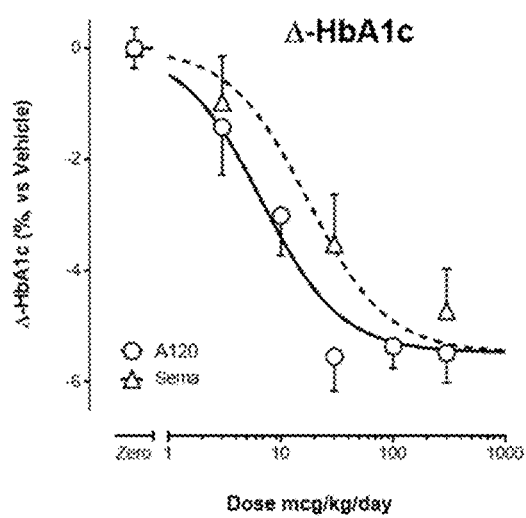
FIG. 2B illustrates comparative in vivo type 2 diabetic potencies (i.e., HbA1c lowering) in DIO rats for compound A120 vs semaglutide (Δ-HbA1c vs vehicle over 28 days, n=9/dose). Antidiabetic potencies were compared against a ZDF rat model for type 2 diabetes.

In vivo potencies for weight loss and type 2 diabetes in DIO rats were tested for a representative long-acting GLP-1 receptor agonist of the present invention (A120) and compared against potencies for semaglutide (Novo Nordisk A/S Bagsvaerd, Denmark). Comparative in vivo potencies for weight loss in DIO rats are shown in FIG. 2A for both compounds (% baseline vs vehicle over 28 days, n=6/dose). Comparative in vivo potencies for type 2 diabetes (i.e., HbA1c lowering) in DIO rats are shown in FIG. 2B for both compounds (Δ-HbA1c vs vehicle over 28 days, n=9/dose). Antidiabetic potencies were compared against a ZDF rat model for type 2 diabetes.

Compound A120 was found to be about 2.3 times more potent than semaglutide for weight loss, and about 2.6 times more potent than semaglutide for HbA1c lowering. When adjusted for cognate pharmacokinetic parameters, human potency for compound A120 is projected to be about 3.1 times that of semaglutide.

Example 17: In Vitro Metabolic Stability Pharmacokinetics Studies (T1/2) of GLP-1 Receptor Agonists Rat and Human Kidney Brush Border Membranes In vitro incubations in kidney brush border membrane (kBBM) preparations were used to characterize the ability of peptides to resist degradation by proteases and peptidases in the systemic circulation. kBBM were selected because they contain a high concentration of a diverse set of proteases and peptidases, many of which are present throughout the body. Generally, peptides with low in vivo CL are stable in this assay, while peptides with high in vivo CL are unstable in this assay.

Brush border membranes from rat and human kidney tissue were prepared via centrifugation and stored at −70° C. Thawed stocks of rat or human kBBM were diluted to the appropriate concentration in 25 mM HEPES buffer (pH 7.4) containing 1% casein and aliquoted into a 96-well plate. The kBBM solutions were pre-warmed for 10 minutes at 37° C. Reactions were initiated by the addition of test peptide (1 mcM final concentration) also dissolved in 25 mM HEPES buffer (pH 7.4) containing 1% casein. The final concentration of kBBM in each incubation was 50 mcg protein/mL. Reactions were maintained at 37° C. in a shaking water bath. At 0, 0.25, 0.5, 1.0, 2.0, and 4.0 h post-initiation, 30 mcL of the reaction mixture was removed and placed into a 96-well plate containing 120 mcL of ice-cold methanol containing 2.5% formic acid. Quenched samples were centrifuged at 2178×g for 10 min and then a portion of the supernatants were transferred to a clean 96-well plate and diluted 1:1 with water. Samples were analyzed by UPLC-MS/MS. The results of this analysis for compound A120 (SEQ ID NO: 120) are shown in Table 20.

Human Subcutaneous Tissue Homogenates

In vitro incubations in subcutaneous (SC) tissue homogenates were used to characterize the ability of peptides to resist pre-systemic degradation by proteases and peptidases after SC administration. In vivo nonclinical studies have shown that peptidase activity in the SC space can limit the bioavailability of a peptide after SC administration. Peptides with high SC bioavailability are stable in this assay, while peptides with low SC bioavailability are unstable in this assay.

Human SC tissue was homogenized in cold 25 mM HEPES buffer (pH 7.4, 10-fold volume based on sample weight), and then filtered through a double layer of cheesecloth. The filtrates were aliquoted, flash frozen on a methanol/dry ice bath and stored at −80° C. The protein concentration of each pooled batch was determined using the BCA protein assay. Thawed stocks of human SC tissue homogenates were diluted to 1.0 mg protein/mL in 25 mM HEPES buffer (pH 7.4) and aliquoted into a 96-well plate. The diluted SC homogenates were pre-warmed for 10 minutes at 37° C. Reactions were initiated by the addition of test peptide (10 mcM final concentration) also dissolved in 25 mM HEPES buffer (pH 7.4). Reactions were maintained at 37° C. in a shaking water bath. At 0, 0.25, 0.5, 1.0, 2.0, and 4.0 h post-initiation, 50 mcL of the reaction mixture was removed and placed into a 96-well plate containing 150 mcL of ice-cold methanol containing 2.5% formic acid. Quenched samples were centrifuged at 2178×g for 10 min and then a portion of the supernatants were transferred to a clean 96-well plate and diluted 1:10 with water. Samples were analyzed by UPLC-MS/MS. The results of this analysis for compound A120 (SEQ ID NO: 120) are shown in Table 20.

Fraction Unbound ($F_u$) in Plasma

Conventional methods of measuring plasma protein binding, such as equilibrium dialysis, ultrafiltration and ultracentrifugation, are not reliable with peptides because of their tendency to adsorb to the surface of plastic tubing, dialysis membranes and molecular weight cut-off filters. As a result, the extent to which acylated peptides bind to serum albumin was evaluated using surface plasmon resonance (SPR). The utility of this technique to provide a reasonable estimation of the fraction of a drug bound to plasma protein has been demonstrated in the literature. The results of this analysis for compound A120 (SEQ ID NO: 120) are shown in Table 20. The estimated half life of compound A120 in humans based off this data is approximately 6 days.

TABLE 20

Metabolic stability pharmacokinetics and fraction unbound of GLP-1 receptor agonist compound A120

|  | kBBM t1/2(hr) | SC tissue stability t1/2(hr) | % $f_u$ |
|---|---|---|---|
| Rat | >12 | 12 | 0.98% |
| Monkey | >12 | >12 | 0.62% |
| Human | >12 | >12 | 0.78% |

Example 18: In Vivo Pharmacokinetic Parameters of Compound A120 in Rat and Monkey Models Pharmacokinetic profiles of compound A120 in rat and monkey models were determined following intravenous infusion, subcutaneous bolus injection, or subcutaneous infusion of the compound. The results of these analyses are presented in Table 21.

TABLE 21

Pharmacokinetic and ADME profile of compound A120 in rat and monkey models

| Species | Route | Dose (mg/kg) | CL (mL/min/kg) | $V_{ss}$ (mL/kg) | $T_{1/2}$ (hr) | $AUC_{inf}$ (ng*hr/mL) | $T_{max}$ (hr) | $C_{max}$ (ng/mL) | F (%) |
|---|---|---|---|---|---|---|---|---|---|
| Rat | IV infusion (n = 3) | 0.033 | 0.055 | 56.5 | 15.8 | 10,400 | 1.2 | 969 | — |
|  | SC bolus (n = 3) | 0.10 | — | — | 17.8 | 29,400 | 8.0 | 748 | 92.9 |
| Monkey | IV infusion (n = 4) | 0.050 | 0.0074 | 49.8 | 92.9 | 114,000 | 1.0 | 2660 | — |
|  | SC infusion (n = 2) | 0.050 | — | — | 116 | 108,000 | 24 | 682 | 94.3 |

"—" = not determined; data shown as mean; median value provided for $T_{max}$

Example 19: Albumin Binding of Long Acting GLP-1 Receptor Agonists

Figure 4:
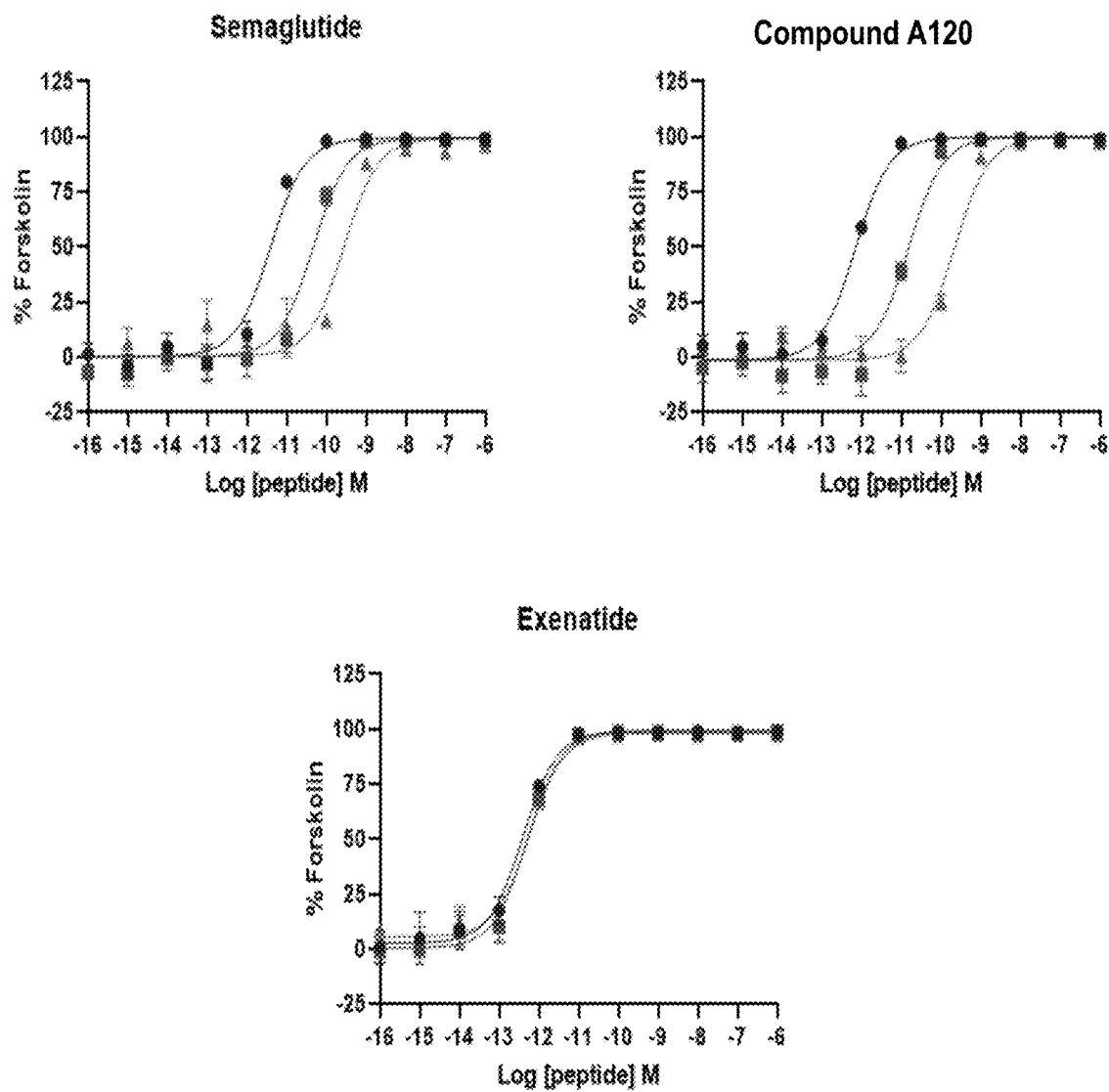
FIG. 4 depicts the potency shift of conjugated GLP-1 receptor agonists by human serum albumin (HSA) binding.
Figure 5:
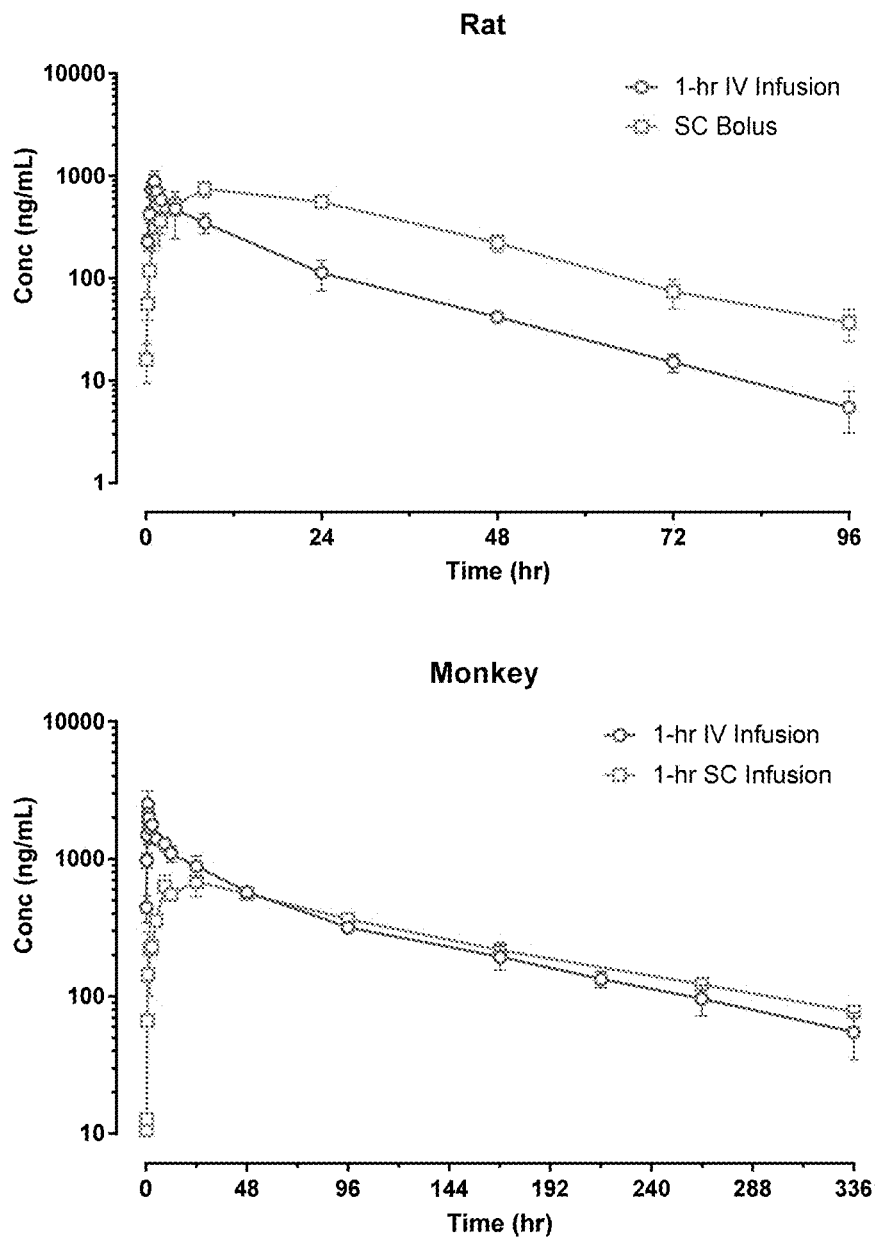
FIG. 5 depicts the change in plasma concentration of compound A120 in rats and monkeys following intravenous and subcutaneous administration.
Figure 6:
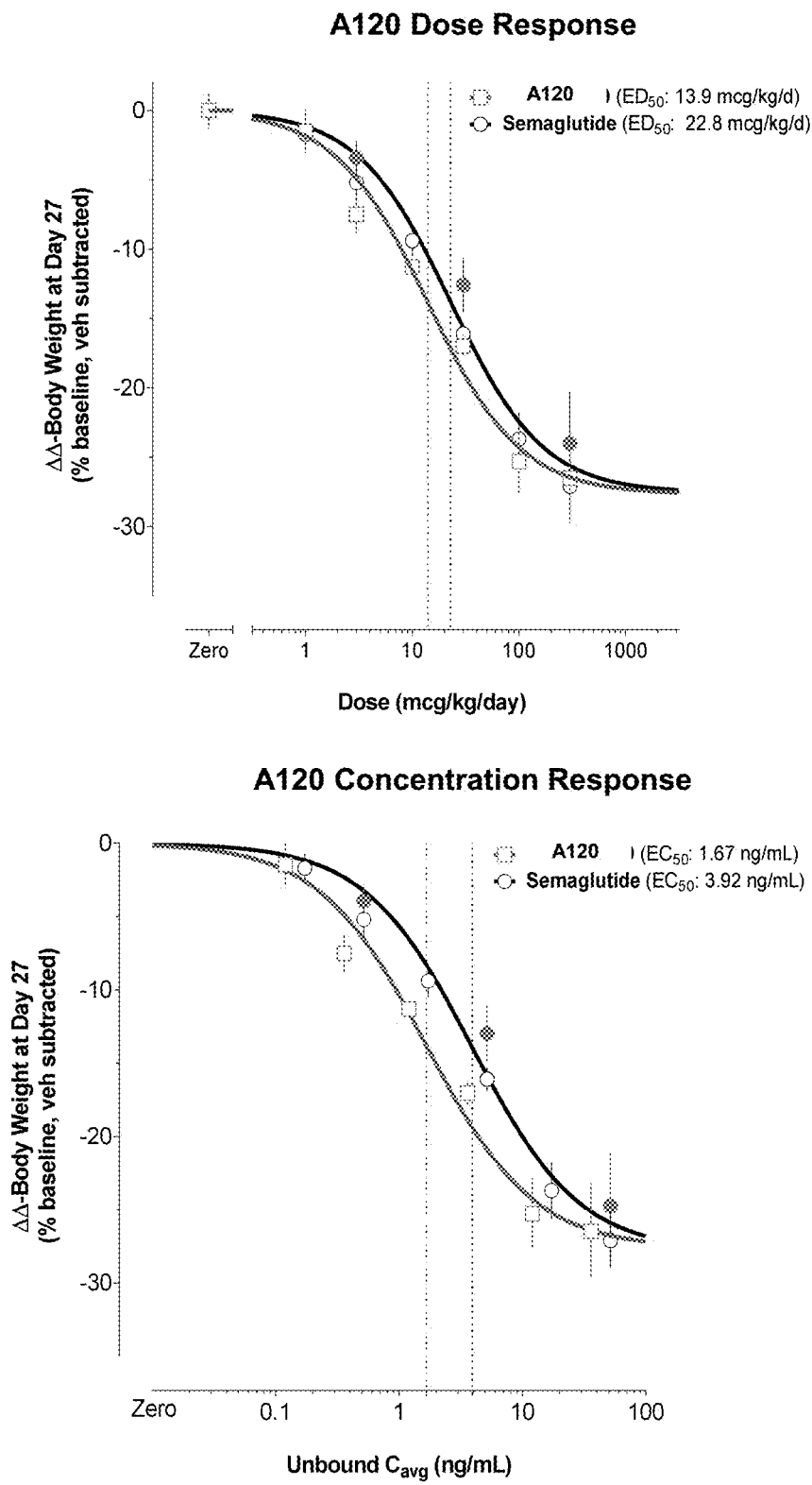
FIG. 6 depicts dose and concentration response of body weight loss in male Long Evans (LE) Diet Induced Obesity (DIO) rats treated with compound A120 for 27 days. Male LE DIO rats at 18 weeks of age (14 weeks on high fat diet) were dosed (SC; every other day) with six doses of compound A120 ranging from 1 to 300 mcg/kg/day (n=6 animals/dose). Shaded and open circles represent replicate doses (3, 30, 300 mcg/kg/day) of semaglutide from two separate studies.
Figure 7:
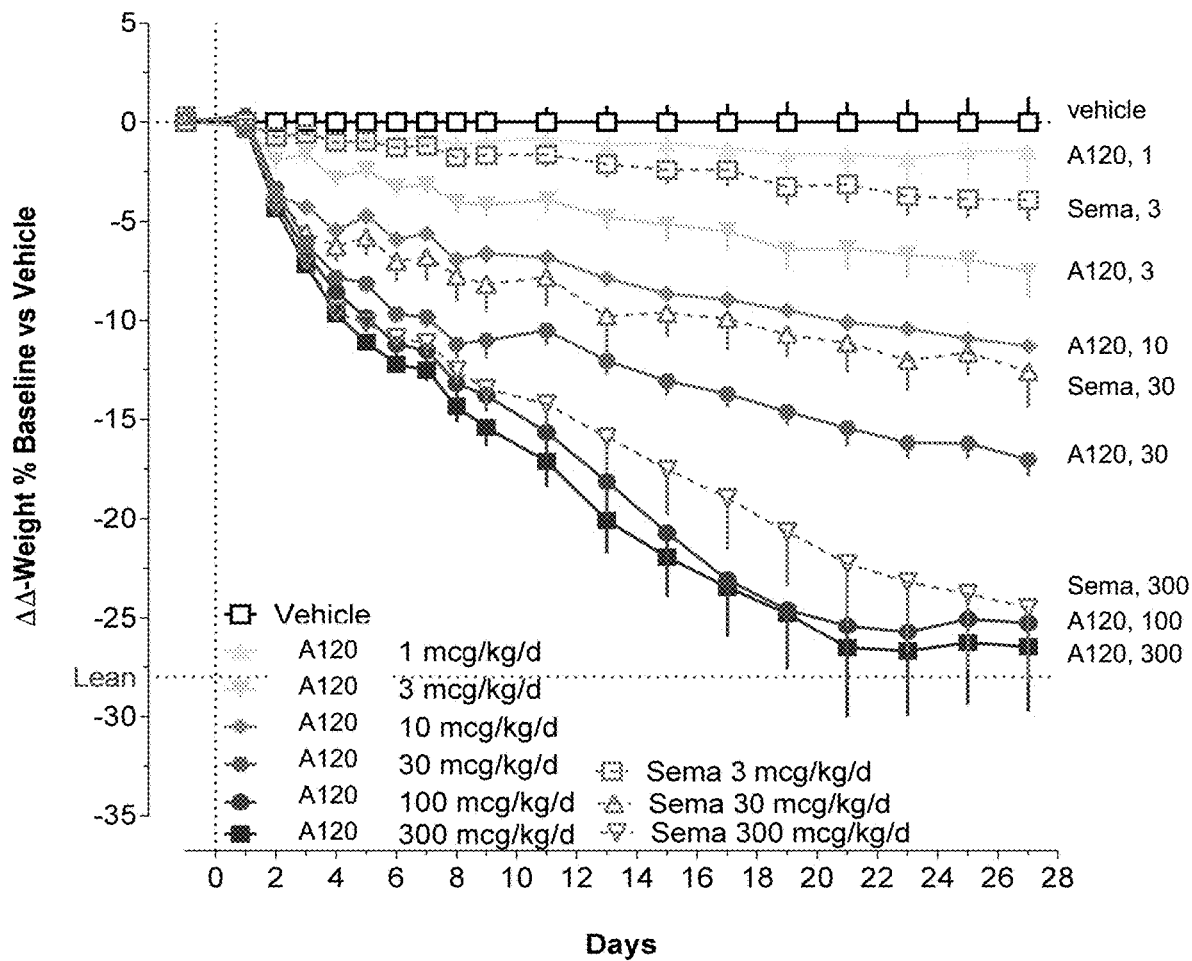
FIG. 7 depicts semaglutide- and A120-induced weight loss in male LE DIO rats over a 27-day period.
Figure 8:
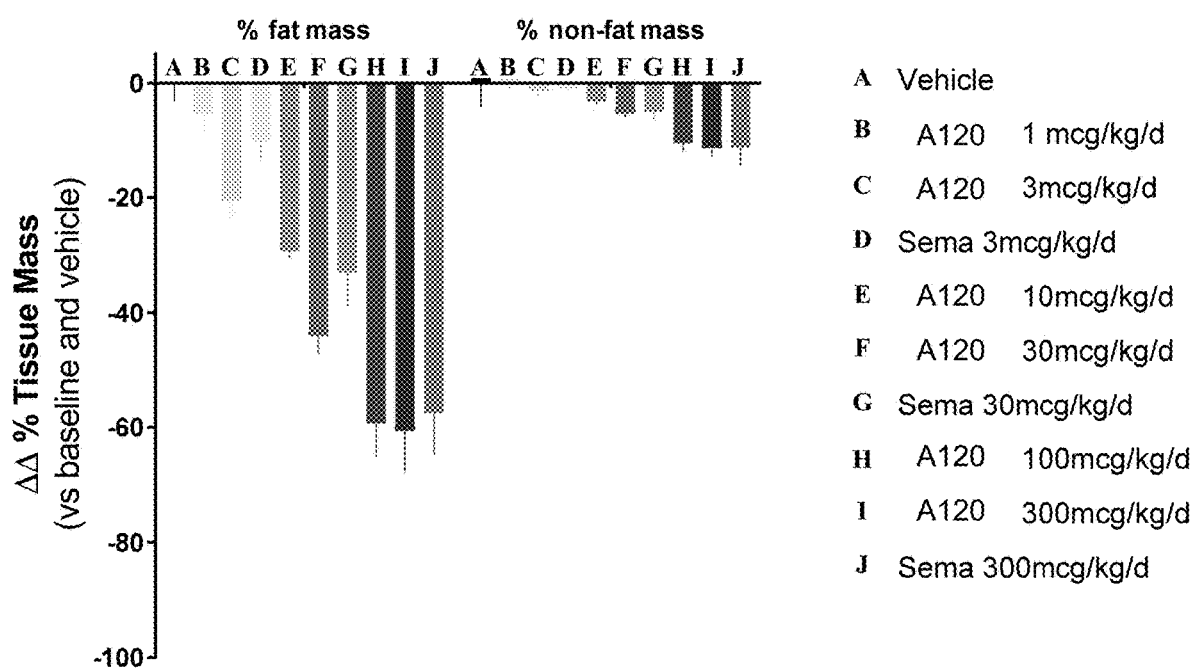
FIG. 8 depicts semaglutide- and A120-induced changes in body composition in male LE DIO rats, highlighting the fact that changes in body composition were primarily due to fat mass loss (body composition was determined on day 26 using quantitative magnetic resonance).
Figure 9:
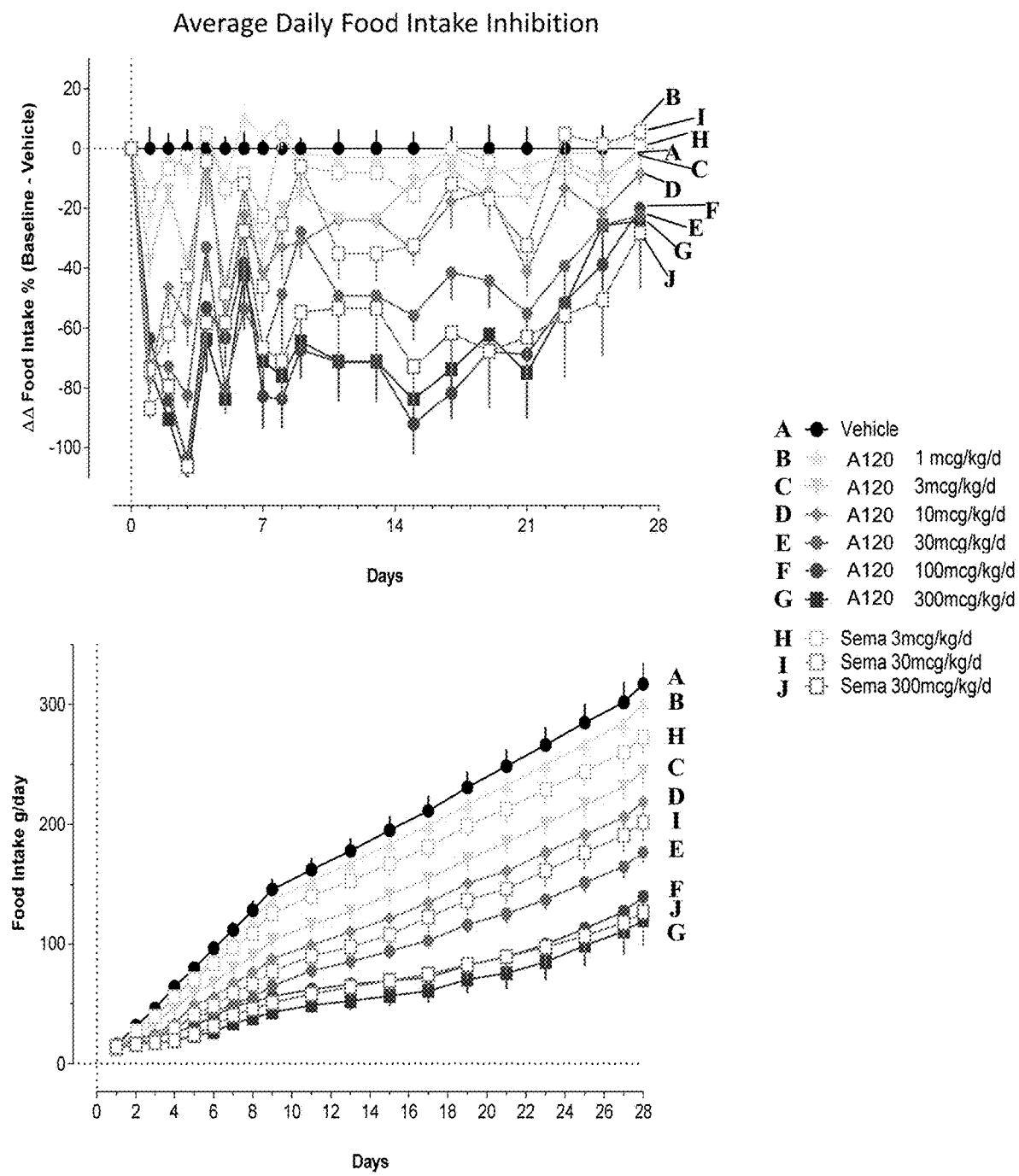
FIG. 9 depicts average daily food intake inhibition and cumulative food intake of mice administered varying doses of compound A120 or semaglultide.
Figure 10:
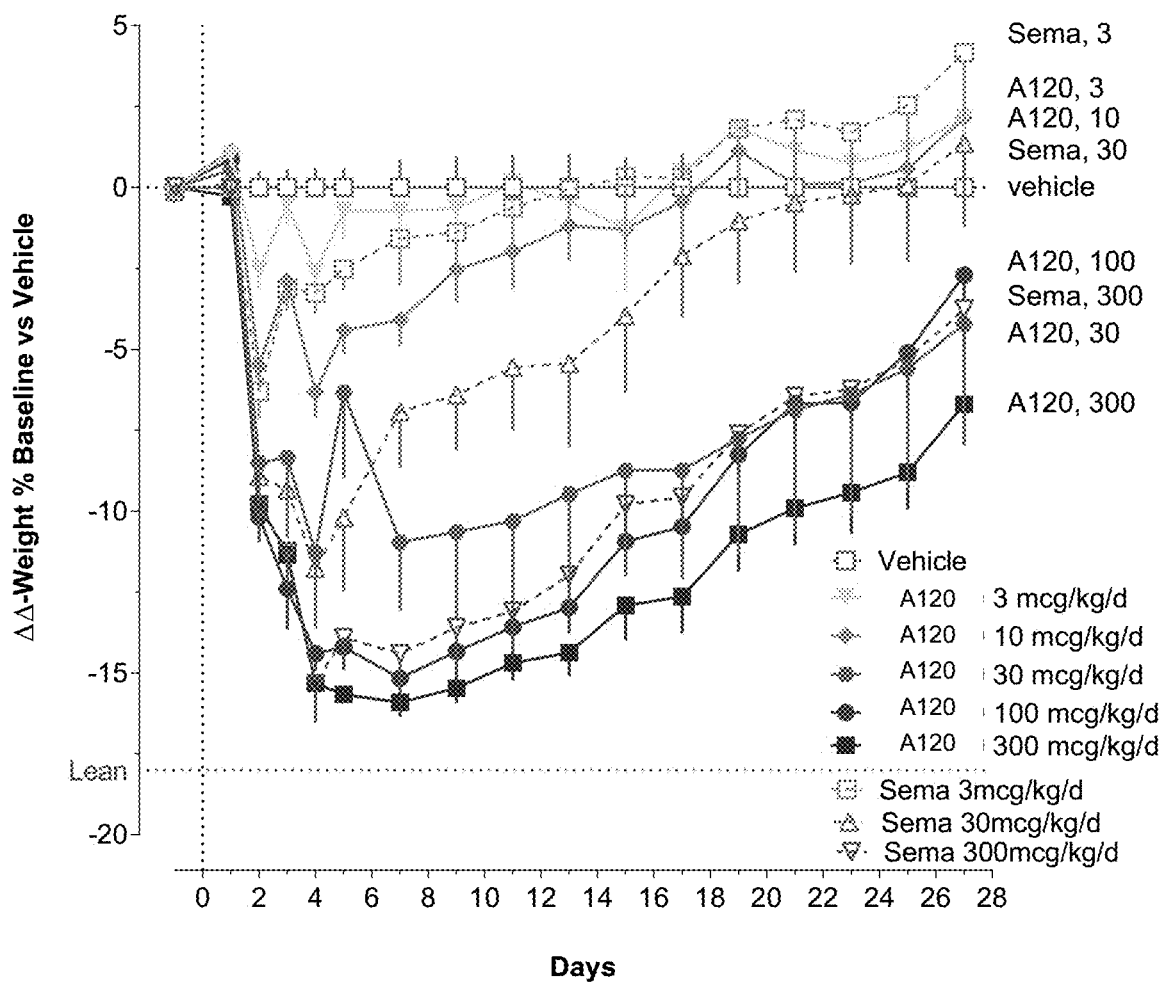
FIG. 10 depicts the reduction in body weight of male Zucker Diabetic Fatty (ZDF) rats dosed (SC injection; every other day) with compound A120 or semaglutide.
Figure 11:
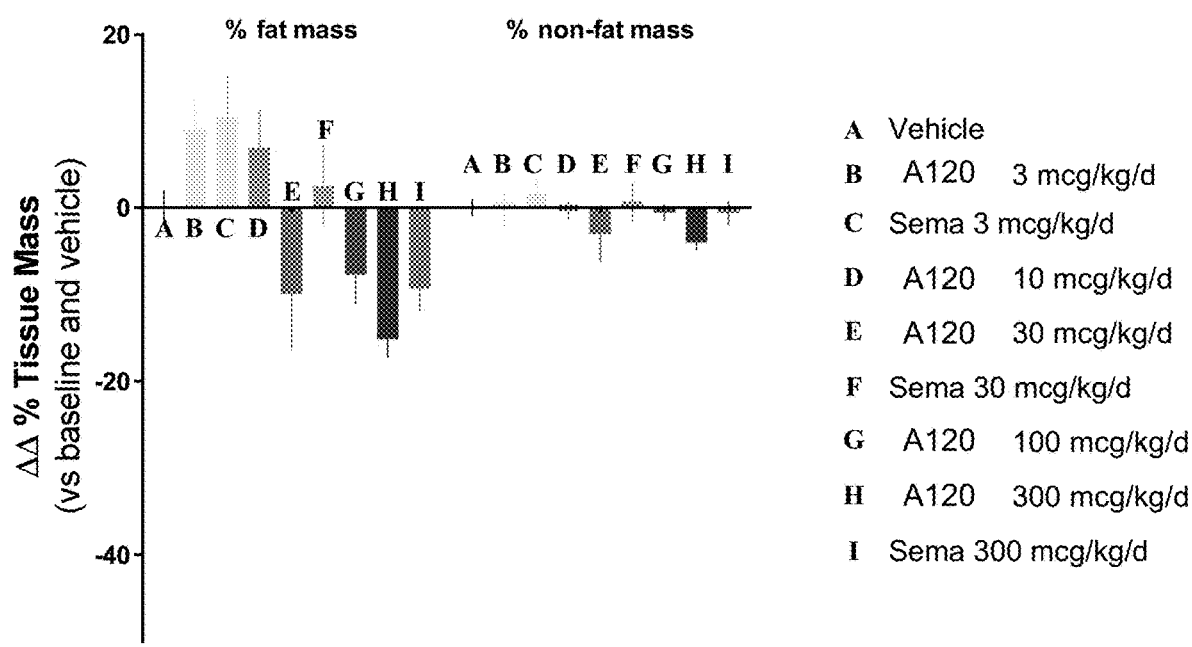
FIG. 11 depicts semaglutide- and A120-induced changes in body composition in male ZDF rats, highlighting the fact that changes in body composition were primarily due to fat mass loss (body composition was determined on day 25).

The potency shifting of conjugated GLP-1 receptor agonists can be seen in Table 22. Data was obtained using a cAMP accumulation assay on the GLP-1 receptor for each of GLP-1 (7-36), semaglutide, exenatide, and compound A120 in the presence of various concentrations of human serum albumin (HSA). The results of this analysis are also presented in FIG. 4.

TABLE 22 pEC$_{50}$ values of various GLP-1 receptor agonists in the presence of human serum albumin

|  | 0% HSA | 0.1% HSA | 4% HSA |
|---|---|---|---|
| GLP-1 (7-36) | 12.1 | — | — |
| Semaglultide | 11.6 | 10.3 | 9.24 |
| Exenatide | 12.2 | 12.2 | 12.1 |
| Compound A120 | 12.1* | 10.8 | 9.60 |

"—" = not determined;
*significantly different when compared to semaglutide (p < 0.01)

Example 20: Potency of a Long Acting GLP-1 Receptor Agonist Across Species

The potencies of GLP-1 (7-36), semaglutide, exenatide, and compound A120 were determined against human (h), cyno (c), and rat (r) orthologs of the GLP-1 receptor (GLP-1R), the glucagon receptor (GCGR), and the gastric inhibitor polypeptide receptor (GIPR). Values were obtained via cAMP accumulation assay. The results of these analyses are presented in Table 23.

TABLE 23

Activity (as pEC$_{50}$ values) of various GLP-1 receptor agonists against human, cyno, and rat GLP-1 receptors, glucagon receptors, and gastic inhibitor polypeptide receptors determined via cAMP accumulation assay

|  | hGLP-1R | rGLP-1R | cGLP-1R | hGCGR | rGCGR | cGCGR | hGIPR | rGIPR |
|---|---|---|---|---|---|---|---|---|
| Semaglutide | 11.6 | 11.6 | 11.6 | <9 | <9 | <9 | <9 | <9 |
| Exenatide | 12.2 | 12.0 | 12.1 | — | — | — | — | — |
| Human GLP-1(7-36) amide | 12.1 | 11.9 | 11.9 | — | — | — | — | — |
| Compound A120 | 12.1 | 11.8 | 11.8 | <9 | <9 | <9 | <9 | <9 |

"—" = not determined

The data indicate that compound A120 is consistently potent against GLP-1R across three relevant species and that the compound is highly selective for GLP-1R over GCGR and GIPR.

Example 21: Comparative Data of Compound A120 Against Semaglutide

TABLE 24

Comparison of selected data for compound A120 and semaglutide against desired metrics

|  | Human in vitro potency | | Physicochemical properties | | RatPK | Monkey PK |
|---|---|---|---|---|---|---|
|  | hGLP-1 (pEC$_{50}$) | hGCGR (pEC$_{50}$) | Solubility* (mg/mL) | Stability** | Cl/% F (Cl in mL/min/kg) | Cl/% F (Cl in mL/min/kg) |
| Compound A120 | 12.1 | <9 | 101/96 | 85.7% | 0.054/93% | 0.00757/94% |
| Semaglutide | 11.6 | <9 | <0.08/<0.07 | NA | 0.128/80% | 0.00928/66% |
| Desired value | ≥12.0 | <12.0 | >40 | >90% | ≥80% F | ≥80% F |

*solubility = water/saline;
**stability = 30 days @ 37° C. (1 mg/mL);
NA = highly cloudy/unable to assess stability via HPLC

TABLE 25

Comparison of in vivo potency and efficacy data for compound A120 and semaglutide against desired metrics

|  | % Weight loss* | | % Change HbA1c** | |
|---|---|---|---|---|
|  | ED$_{50}$/EC$_{50}$ (ED$_{50}$ = mcg/kg/day) (EC$_{50}$ = ng/mL) | at 300 mcg/kg/day dose | ED$_{50}$/EC$_{50}$ (ED$_{50}$ = mcg/kg/day) (EC$_{50}$ = ng/mL) | at 300 mcg/kg/day dose |
| Compound A120 | 17/1.7 | 27% | 7/0.9 | 5.4% |
| Semaglutide | 23/3.9 | 24% | 36/6 | 4.8% |
| Desired value | <100 | >10% | <100 | ≥2% |

*ΔΔ % weight decrease in DIO rat at day 27;
**ΔΔ % change in HbA1c in ZDF rat at day 27

OTHER EMBODIMENTS

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (9128 sequences)

SEQ ID NO: 1 - protein, 39 aa, Artificial Sequence
  Description of Artificial Sequence: Synthetic polypeptide
HGEGTFTSDLSKQKEEEAVRLFIEWLKNGGPSSGAPPPS

SEQ ID NO: 2 - protein, 39 aa, Artificial Sequence
  Description of Artificial Sequence: Synthetic polypeptide
HGEGTFTSDLSKQMEEKAVRLFIEWLKNGGPSSGAPPPS

SEQ ID NO: 3 - protein, 39 aa, Artificial Sequence
  Description of Artificial Sequence: Synthetic polypeptide
HGEGTFTSDLSKQMEEEKVRLFIEWLKNGGPSSGAPPPS

SEQ ID NO: 4 - protein, 39 aa, Artificial Sequence
  Description of Artificial Sequence: Synthetic polypeptide
HGEGTFTSDLSKQMEEEAVKLFIEWLKNGGPSSGAPPPS

SEQ ID NO: 5 - protein, 39 aa, Artificial Sequence
  Description of Artificial Sequence: Synthetic polypeptide
HGEGTFTSDLSKQMEEEAVRKFIEWLKNGGPSSGAPPPS

SEQ ID NO: 6 - protein, 39 aa, Artificial Sequence
  Description of Artificial Sequence: Synthetic polypeptide
HGEGTFTSDLSKQMEKEAVRLFIEWLKNGGPSSGAPPPS

SEQ ID NO: 7 - protein, 39 aa, Artificial Sequence; identical to SEQ ID NO: 6
  Description of Artificial Sequence: Synthetic polypeptide

SEQ ID NO: 8 - protein, 39 aa, Artificial Sequence; identical to SEQ ID NO: 6
  Description of Artificial Sequence: Synthetic polypeptide

SEQ ID NO: 9 - protein, 39 aa, Artificial Sequence; identical to SEQ ID NO: 6
  Description of Artificial Sequence: Synthetic polypeptide

SEQ ID NO: 10 - protein, 39 aa, Artificial Sequence; identical to SEQ ID NO: 6
  Description of Artificial Sequence: Synthetic polypeptide

SEQ ID NO: 11 - protein, 39 aa, Artificial Sequence; identical to SEQ ID NO: 6
  Description of Artificial Sequence: Synthetic polypeptide

SEQ ID NO: 12 - protein, 39 aa, Artificial Sequence; identical to SEQ ID NO: 6
  Description of Artificial Sequence: Synthetic polypeptide
  MOD_RES (16)..(16): D-Lys

SEQ ID NO: 13 - protein, 39 aa, Artificial Sequence
  Description of Artificial Sequence: Synthetic polypeptide
HGEGTFTSDLSKQLEKEAVRLFIEWLKNGGPSSGAPPPS

SEQ ID NO: 14 - protein, 39 aa, Artificial Sequence
  Description of Artificial Sequence: Synthetic polypeptide
HGEGTFTSDLSKQFEKEAVRLFIEWLKNGGPSSGAPPPS

SEQ ID NO: 15 - protein, 39 aa, Artificial Sequence
  Description of Artificial Sequence: Synthetic polypeptide
HGEGTFTSDLSKQYEKEAVRLFIEWLKNGGPSSGAPPPS

SEQ ID NO: 16 - protein, 39 aa, Artificial Sequence
  Description of Artificial Sequence: Synthetic polypeptide
HGEGTFTSDLSKQQEKEAVRLFIEWLKNGGPSSGAPPPS

SEQ ID NO: 17 - protein, 39 aa, Artificial Sequence
  Description of Artificial Sequence: Synthetic polypeptide
HGEGTFTSDLSKYMEKEAVRLFIEWLKNGGPSSGAPPPS

SEQ ID NO: 18 - protein, 39 aa, Artificial Sequence
  Description of Artificial Sequence: Synthetic polypeptide
HGEGTFTSDLSKEMEKEAVRLFIEWLKNGGPSSGAPPPS

SEQ ID NO: 19 - protein, 39 aa, Artificial Sequence
  Description of Artificial Sequence: Synthetic polypeptide
HGEGTFTSDLSKKMEKEAVRLFIEWLKNGGPSSGAPPPS

SEQ ID NO: 20 - protein, 39 aa, Artificial Sequence
  Description of Artificial Sequence: Synthetic polypeptide
HGEGTFTSDLSKSMEKEAVRLFIEWLKNGGPSSGAPPPS

SEQ ID NO: 21 - protein, 39 aa, Artificial Sequence
  Description of Artificial Sequence: Synthetic polypeptide
HAEGTFTSDLSKQMEKEAVRLFIEWLKNGGPSSGAPPPS

SEQ ID NO: 22 - protein, 39 aa, Artificial Sequence
  Description of Artificial Sequence: Synthetic polypeptide
  MOD_RES (2)..(2): Aib
HXEGTFTSDLSKQMEKEAVRLFIEWLKNGGPSSGAPPPS

SEQ ID NO: 23 - protein, 39 aa, Artificial Sequence; identical to SEQ ID NO: 21
  Description of Artificial Sequence: Synthetic polypeptide
  MOD_RES (3)..(3): n-methyl-E

SEQ ID NO: 24 - protein, 39 aa, Artificial Sequence; identical to SEQ ID NO: 6
  Description of Artificial Sequence: Synthetic polypeptide

SEQ ID NO: 25 - protein, 39 aa, Artificial Sequence; identical to SEQ ID NO: 6
  Description of Artificial Sequence: Synthetic polypeptide

SEQ ID NO: 26 - protein, 39 aa, Artificial Sequence; identical to SEQ ID NO: 6
  Description of Artificial Sequence: Synthetic polypeptide

SEQ ID NO: 27 - protein, 39 aa, Artificial Sequence
  Description of Artificial Sequence: Synthetic polypeptide
HGEGTFTSDLSKQYEKEAVRLFIAWLKNGGPSSGAPPPS

SEQ ID NO: 28 - protein, 39 aa, Artificial Sequence
  Description of Artificial Sequence: Synthetic polypeptide
HGEGTFTSDLSKQYEKEAVRLFISWLKNGGPSSGAPPPS

SEQ ID NO: 29 - protein, 39 aa, Artificial Sequence
  Description of Artificial Sequence: Synthetic polypeptide
HGEGTFTSDLSKQYEKEAVRLFIKWLKNGGPSSGAPPPS

SEQ ID NO: 30 - protein, 39 aa, Artificial Sequence
  Description of Artificial Sequence: Synthetic polypeptide
HGEGTFTSDLSKQYEKEAVRLFIQWLKNGGPSSGAPPPS

SEQ ID NO: 31 - protein, 39 aa, Artificial Sequence
  Description of Artificial Sequence: Synthetic polypeptide
HGEGTFTSDLSKQYEKEAVRLFIYWLKNGGPSSGAPPPS

SEQ ID NO: 32 - protein, 39 aa, Artificial Sequence
  Description of Artificial Sequence: Synthetic polypeptide
  MOD_RES (24)..(24): Aib
HGEGTFTSDLSKQYEKEAVRLFIXWLKNGGPSSGAPPPS

SEQ ID NO: 33 - protein, 39 aa, Artificial Sequence; identical to SEQ ID NO: 6
  Description of Artificial Sequence: Synthetic polypeptide

SEQ ID NO: 34 - protein, 39 aa, Artificial Sequence; identical to SEQ ID NO: 6
  Description of Artificial Sequence: Synthetic polypeptide

SEQ ID NO: 35 - protein, 39 aa, Artificial Sequence; identical to SEQ ID NO: 6
  Description of Artificial Sequence: Synthetic polypeptide

SEQ ID NO: 36 - protein, 39 aa, Artificial Sequence; identical to SEQ ID NO: 6
  Description of Artificial Sequence: Synthetic polypeptide

SEQ ID NO: 37 - protein, 39 aa, Artificial Sequence; identical to SEQ ID NO: 6
  Description of Artificial Sequence: Synthetic polypeptide

SEQ ID NO: 38 - protein, 39 aa, Artificial Sequence; identical to SEQ ID NO: 6
  Description of Artificial Sequence: Synthetic polypeptide

SEQ ID NO: 39 - protein, 39 aa, Artificial Sequence
  Description of Artificial Sequence: Synthetic polypeptide
HGEGTFTSDLSKQYEKEAVREFIEWLKNGGPSSGAPPPS

SEQ ID NO: 40 - protein, 39 aa, Artificial Sequence
  Description of Artificial Sequence: Synthetic polypeptide
HGEGTFTSDLSKQYEKEAVRYFIEWLKNGGPSSGAPPPS

SEQ ID NO: 41 - protein, 39 aa, Artificial Sequence
  Description of Artificial Sequence: Synthetic polypeptide
HGEGTFTSDLSKQYEKEAVRQFIEWLKNGGPSSGAPPPS

SEQ ID NO: 42 - protein, 39 aa, Artificial Sequence
  Description of Artificial Sequence: Synthetic polypeptide
HGEGTFTSDLSKQYEKEAVRKFIEWLKNGGPSSGAPPPS

SEQ ID NO: 43 - protein, 39 aa, Artificial Sequence
  Description of Artificial Sequence: Synthetic polypeptide
  MOD_RES (21)..(21): Aib
HGEGTFTSDLSKQYEKEAVRXFIEWLKNGGPSSGAPPPS

SEQ ID NO: 44 - protein, 39 aa, Artificial Sequence
  Description of Artificial Sequence: Synthetic polypeptide
HGEGTFTSDLSKQYEKEAVRHFIEWLKNGGPSSGAPPPS

SEQ ID NO: 45 - protein, 39 aa, Artificial Sequence
  Description of Artificial Sequence: Synthetic polypeptide
  MOD_RES (2)..(2): Aib
HXEGTFTSDLSKQYEKEAVRLFISWLKNGGPSSGAPPPS

SEQ ID NO: 46 - protein, 39 aa, Artificial Sequence
  Description of Artificial Sequence: Synthetic polypeptide
  MOD_RES (2)..(2): Aib
HXEGTFTSDLSKQYEKEAVRLFIEWLKNGGPSSGAPPPS

SEQ ID NO: 47 - protein, 39 aa, Artificial Sequence
  Description of Artificial Sequence: Synthetic polypeptide
HGEGTFTSELSKQYEKEAVRLFIEWLKNGGPSSGAPPPS

SEQ ID NO: 48 - protein, 39 aa, Artificial Sequence
  Description of Artificial Sequence: Synthetic polypeptide
HGEGTFTSDLSKQYEKEAAKLFISWLKNGGPSSGAPPPS

SEQ ID NO: 49 - protein, 39 aa, Artificial Sequence
  Description of Artificial Sequence: Synthetic polypeptide
HGEGTFTSDLSKQYEKEAARLFISWLKNGGPSSGAPPPS

SEQ ID NO: 50 - protein, 39 aa, Artificial Sequence
  Description of Artificial Sequence: Synthetic polypeptide
  MOD_RES (32)..(32): Dap
HGEGTFTSDLSKQYEKEAVRLFISWLKNGGPXSGAPPPS

SEQ ID NO: 51 - protein, 39 aa, Artificial Sequence
  Description of Artificial Sequence: Synthetic polypeptide
HGEGTFTSDLSKQYEKEAVRLFISWLKNGGPKSGAPPPS

SEQ ID NO: 52 - protein, 39 aa, Artificial Sequence
  Description of Artificial Sequence: Synthetic polypeptide
HGEGTFTSDLSKQYEKEAVRLFISWLKNGGPHSGAPPPS

SEQ ID NO: 53 - protein, 39 aa, Artificial Sequence
  Description of Artificial Sequence: Synthetic polypeptide
HGEGTFTSDLSKQYEKEAVRLFISWLKNGGPRSGAPPPS

SEQ ID NO: 54 - protein, 39 aa, Artificial Sequence
  Description of Artificial Sequence: Synthetic polypeptide
  MOD_RES (2)..(2): Aib
HXEGTFTSDLSKQYEKEAVREFIEWLKNGGPSSGAPPPS

SEQ ID NO: 55 - protein, 39 aa, Artificial Sequence
  Description of Artificial Sequence: Synthetic polypeptide
  MOD_RES (2)..(2): Aib
HXEGTFTSDLSKQYEKEAVRQFIEWLKNGGPSSGAPPPS

SEQ ID NO: 56 - protein, 39 aa, Artificial Sequence
  Description of Artificial Sequence: Synthetic polypeptide
  MOD_RES (2)..(2): Aib
HXEGTFTSDLSKQYEKEAARLFIEWLKNGGPSSGAPPPS

SEQ ID NO: 57 - protein, 39 aa, Artificial Sequence
  Description of Artificial Sequence: Synthetic polypeptide
  MOD_RES (2)..(2): Aib
HXEGTFTSDLSKQYEKEAARLFIEWLKNGGPHSGAPPPS

SEQ ID NO: 58 - protein, 39 aa, Artificial Sequence
  Description of Artificial Sequence: Synthetic polypeptide
  MOD_RES (2)..(2): Aib
HXEGTFTSDLSKQYEKEAVRLFIEWLKDGGPSSGAPPPS

SEQ ID NO: 59 - protein, 39 aa, Artificial Sequence
  Description of Artificial Sequence: Synthetic polypeptide
  MOD_RES (2)..(2): Aib
HXEGTFTSDLSKQYEKEAVRLFIEWLKKGGPSSGAPPPS

SEQ ID NO: 60 - protein, 39 aa, Artificial Sequence
  Description of Artificial Sequence: Synthetic polypeptide
  MOD_RES (2)..(2): Aib
HXEGTFTSDLSKQYEKEAVRLFIEWLKSGGPSSGAPPPS

SEQ ID NO: 61 - protein, 39 aa, Artificial Sequence
  Description of Artificial Sequence: Synthetic polypeptide
  MOD_RES (2)..(2): Aib
HXEGTFTSDLSKQYEKEAAREFISWLKNGGPHSGAPPPS

SEQ ID NO: 62 - protein, 39 aa, Artificial Sequence
  Description of Artificial Sequence: Synthetic polypeptide
  MOD_RES (2)..(2): Aib
HXEGTFTSDLSKQYEKEAARKFISWLKNGGPHSGAPPPS

SEQ ID NO: 63 - protein, 39 aa, Artificial Sequence
  Description of Artificial Sequence: Synthetic polypeptide
  MOD_RES (2)..(2): Aib
HXEGTFTSDLSKQYEKEAARKFIEWLKNGGPHSGAPPPS

SEQ ID NO: 64 - protein, 39 aa, Artificial Sequence
  Description of Artificial Sequence: Synthetic polypeptide
  MOD_RES (2)..(2): Aib
HXEGTFTSDLSKQYEKEAARQFISWLKNGGPHSGAPPPS

SEQ ID NO: 65 - protein, 39 aa, Artificial Sequence
  Description of Artificial Sequence: Synthetic polypeptide
  MOD_RES (2)..(2): Aib
HXEGTFTSDLSKQYEKEAAREFIEWLKNGGPKSGAPPPS

SEQ ID NO: 66 - protein, 39 aa, Artificial Sequence
  Description of Artificial Sequence: Synthetic polypeptide
  MOD_RES (2)..(2): Aib
  MOD_RES (32)..(32): Dap
HXEGTFTSDLSKQYEKEAAREFIEWLKNGGPXSGAPPPS

SEQ ID NO: 67 - protein, 39 aa, Artificial Sequence
  Description of Artificial Sequence: Synthetic polypeptide
  MOD_RES (2)..(2): Aib
HXEGTYTSDLSKQYEKEAAREFIEWLKNGGPSSGAPPPS

SEQ ID NO: 68 - protein, 39 aa, Artificial Sequence
  Description of Artificial Sequence: Synthetic polypeptide
  MOD_RES (2)..(2): Aib
HXEGTFTSDLSQQYEKEAAREFIEWLKNGGPSSGAPPPS

SEQ ID NO: 69 - protein, 39 aa, Artificial Sequence
  Description of Artificial Sequence: Synthetic polypeptide
  MOD_RES (2)..(2): Aib
HXEGTFTSDLSSQYEKEAAREFIEWLKNGGPSSGAPPPS

SEQ ID NO: 70 - protein, 39 aa, Artificial Sequence
  Description of Artificial Sequence: Synthetic polypeptide
  MOD_RES (2)..(2): Aib
HXEGTFTSDLSEQYEKEAAREFIEWLKNGGPSSGAPPPS

SEQ ID NO: 71 - protein, 39 aa, Artificial Sequence
  Description of Artificial Sequence: Synthetic polypeptide
  MOD_RES (2)..(2): Aib
  MOD_RES (16)..(16): Dap
HXEGTFTSDLSKQYEXEAAREFIEWLKNGGPSSGAPPPS

SEQ ID NO: 72 - protein, 39 aa, Artificial Sequence; identical to SEQ ID NO: 71
  Description of Artificial Sequence: Synthetic polypeptide
  MOD_RES (2)..(2): Aib
  MOD_RES (16)..(16): Dab

SEQ ID NO: 73 - protein, 39 aa, Artificial Sequence; identical to SEQ ID NO: 71
  Description of Artificial Sequence: Synthetic polypeptide
  MOD_RES (2)..(2): Aib
  MOD_RES (16)..(16): Orn

SEQ ID NO: 74 - protein, 39 aa, Artificial Sequence
  Description of Artificial Sequence: Synthetic polypeptide
  MOD_RES (2)..(2): Aib
HXEGTFTSDLSKQYEKKAVRLFISWLKNGGPSSGAPPPS

SEQ ID NO: 75 - protein, 39 aa, Artificial Sequence
  Description of Artificial Sequence: Synthetic polypeptide
  MOD_RES (2)..(2): Aib
HXEGTFTSDLSKQYEKEYVRLFISWLKNGGPSSGAPPPS

SEQ ID NO: 76 - protein, 39 aa, Artificial Sequence
  Description of Artificial Sequence: Synthetic polypeptide
  MOD_RES (2)..(2): Aib
HXEGTFTSDLSKQYEKEAAREFIEWLKNGGPSSGAPPPS

SEQ ID NO: 77 - protein, 39 aa, Artificial Sequence
  Description of Artificial Sequence: Synthetic polypeptide
  MOD_RES (2)..(2): Aib
HXEGTFTSDLSKQYEKEAARKFISWLKNGGPSSGAPPPS

SEQ ID NO: 78 - protein, 39 aa, Artificial Sequence
  Description of Artificial Sequence: Synthetic polypeptide
  MOD_RES (2)..(2): Aib
HXEGTFTSDLSKQYEKEAVREFISWLKNGGPSSGAPPPS

SEQ ID NO: 79 - protein, 39 aa, Artificial Sequence
  Description of Artificial Sequence: Synthetic polypeptide
  MOD_RES (2)..(2): Aib
HXEGTFTSDVSEQYEKEAAREFIEWLKNGGPSSGAPPPS

SEQ ID NO: 80 - protein, 39 aa, Artificial Sequence
  Description of Artificial Sequence: Synthetic polypeptide
  MOD_RES (2)..(2): Aib
HXEGTFTSDISEQYEKEAAREFIEWLKNGGPSSGAPPPS

SEQ ID NO: 81 - protein, 39 aa, Artificial Sequence
  Description of Artificial Sequence: Synthetic polypeptide
  MOD_RES (2)..(2): Aib
HXEGTFTNDLSEQYEKEAAREFIEWLKNGGPSSGAPPPS

SEQ ID NO: 82 - protein, 39 aa, Artificial Sequence
  Description of Artificial Sequence: Synthetic polypeptide
  MOD_RES (2)..(2): Aib
HXEGTFTNDVSEQYEKEAAREFIEWLKNGGPSSGAPPPS

SEQ ID NO: 83 - protein, 39 aa, Artificial Sequence
  Description of Artificial Sequence: Synthetic polypeptide
  MOD_RES (2)..(2): Aib
HXEGTFTNDISEQYEKEAAREFIEWLKNGGPSSGAPPPS

SEQ ID NO: 84 - protein, 39 aa, Artificial Sequence
  Description of Artificial Sequence: Synthetic polypeptide
  MOD_RES (2)..(2): Aib
HXEGTFSSDLSEQYEKEAAREFIEWLKNGGPSSGAPPPS

SEQ ID NO: 85 - protein, 39 aa, Artificial Sequence
  Description of Artificial Sequence: Synthetic polypeptide
  MOD_RES (2)..(2): Aib
HXEGTFTSDVSKQYEKEAARLFISWLKNGGPSSGAPPPS

SEQ ID NO: 86 - protein, 39 aa, Artificial Sequence
  Description of Artificial Sequence: Synthetic polypeptide
  MOD_RES (2)..(2): Aib
HXEGTFTSDISKQYEKEAARLFISWLKNGGPSSGAPPPS

SEQ ID NO: 87 - protein, 39 aa, Artificial Sequence
  Description of Artificial Sequence: Synthetic polypeptide
  MOD_RES (2)..(2): Aib
HXEGTFTNDLSKQYEKEAARLFISWLKNGGPSSGAPPPS

SEQ ID NO: 88 - protein, 39 aa, Artificial Sequence
  Description of Artificial Sequence: Synthetic polypeptide
  MOD_RES (2)..(2): Aib
HXEGTFTNDVSKQYEKEAARLFISWLKNGGPSSGAPPPS

SEQ ID NO: 89 - protein, 39 aa, Artificial Sequence
  Description of Artificial Sequence: Synthetic polypeptide
  MOD_RES (2)..(2): Aib
HXEGTFTNDISKQYEKEAARLFISWLKNGGPSSGAPPPS

SEQ ID NO: 90 - protein, 39 aa, Artificial Sequence
  Description of Artificial Sequence: Synthetic polypeptide
  MOD_RES (2)..(2): Aib
HXEGTFTSDLSKQYEKKAVREFISWLKNGGPSSGAPPPS

SEQ ID NO: 91 - protein, 39 aa, Artificial Sequence
  Description of Artificial Sequence: Synthetic polypeptide
  MOD_RES (2)..(2): Aib
HXEGTFTSDLSKQYEKKAARLFISWLKNGGPSSGAPPPS

SEQ ID NO: 92 - protein, 39 aa, Artificial Sequence
  Description of Artificial Sequence: Synthetic polypeptide
  MOD_RES (2)..(2): Aib
HXEGTFTSDLSKQYEKKYVRLFISWLKNGGPSSGAPPPS

SEQ ID NO: 93 - protein, 39 aa, Artificial Sequence
  Description of Artificial Sequence: Synthetic polypeptide
  MOD_RES (2)..(2): Aib
HXEGTFTSDLSKQYEKKYARLFISWLKNGGPSSGAPPPS

SEQ ID NO: 94 - protein, 39 aa, Artificial Sequence
  Description of Artificial Sequence: Synthetic polypeptide
  MOD_RES (2)..(2): Aib
HXEGTFTSDLSKQYEKKYAREFISWLKNGGPSSGAPPPS

SEQ ID NO: 95 - protein, 39 aa, Artificial Sequence
  Description of Artificial Sequence: Synthetic polypeptide
  MOD_RES (2)..(2): Aib
HXEGTFTSDLSKQYEKKYAEEFISWLKNGGPSSGAPPPS

SEQ ID NO: 96 - protein, 39 aa, Artificial Sequence
  Description of Artificial Sequence: Synthetic polypeptide
  MOD_RES (2)..(2): Aib
HXEGTFTSDLSKQYEKEAVRQFISWLKNGGPSSGAPPPS

SEQ ID NO: 97 - protein, 39 aa, Artificial Sequence
  Description of Artificial Sequence: Synthetic polypeptide
  MOD_RES (2)..(2): Aib
HXEGTFTSDLSKQYEKEYAREFISWLKNGGPSSGAPPPS

SEQ ID NO: 98 - protein, 39 aa, Artificial Sequence
  Description of Artificial Sequence: Synthetic polypeptide
  MOD_RES (2)..(2): Aib
HXEGTFTSDLSKQYEKKAAREFISWLKNGGPSSGAPPPS

SEQ ID NO: 99 - protein, 39 aa, Artificial Sequence
  Description of Artificial Sequence: Synthetic polypeptide
  MOD_RES (2)..(2): Aib
HXEGTFTSDLSKQYEKKSAREFISWLKNGGPSSGAPPPS

SEQ ID NO: 100 - protein, 39 aa, Artificial Sequence
  Description of Artificial Sequence: Synthetic polypeptide
  MOD_RES (2)..(2): Aib
HXEGTFTSDLSKQYEKQAAREFISWLKNGGPSSGAPPPS

SEQ ID NO: 101 - protein, 39 aa, Artificial Sequence
  Description of Artificial Sequence: Synthetic polypeptide
  MOD_RES (2)..(2): Aib
HXEGTFTSDLSKQYEKQYAREFISWLKNGGPSSGAPPPS

SEQ ID NO: 102 - protein, 39 aa, Artificial Sequence
  Description of Artificial Sequence: Synthetic polypeptide
  MOD_RES (2)..(2): Aib
HXEGTFTSDLSKQYEKQSAREFISWLKNGGPSSGAPPPS

SEQ ID NO: 103 - protein, 39 aa, Artificial Sequence
  Description of Artificial Sequence: Synthetic polypeptide
  MOD_RES (2)..(2): Aib
HXEGTFTNDVSKQYEKEAAREFISWLKNGGPSSGAPPPS

SEQ ID NO: 104 - protein, 39 aa, Artificial Sequence
  Description of Artificial Sequence: Synthetic polypeptide
  MOD_RES (2)..(2): Aib
HXEGTFTNDVSKQYEKEAVREFISWLKNGGPSSGAPPPS

SEQ ID NO: 105 - protein, 39 aa, Artificial Sequence
  Description of Artificial Sequence: Synthetic polypeptide
  MOD_RES (2)..(2): Aib
HXEGTFTSDISKQYEKEAVRQFIEWLKNGGPSSGAPPPS

SEQ ID NO: 106 - protein, 39 aa, Artificial Sequence
  Description of Artificial Sequence: Synthetic polypeptide
  MOD_RES (2)..(2): Aib
HXEGTFTSDISKQYEKEAARQFIEWLKNGGPSSGAPPPS

SEQ ID NO: 107 - protein, 39 aa, Artificial Sequence
  Description of Artificial Sequence: Synthetic polypeptide
  MOD_RES (2)..(2): Aib
HXEGTFTNDISKQYEKEAAREFISWLKNGGPSSGAPPPS

SEQ ID NO: 108 - protein, 39 aa, Artificial Sequence
  Description of Artificial Sequence: Synthetic polypeptide
  MOD_RES (2)..(2): Aib
HXEGTFTNDISKQYEKEAVREFISWLKNGGPSSGAPPPS

SEQ ID NO: 109 - protein, 39 aa, Artificial Sequence
  Description of Artificial Sequence: Synthetic polypeptide
  MOD_RES (2)..(2): Aib
HXEGTFTNDISKQYEKEAVRQFIEWLKNGGPSSGAPPPS

SEQ ID NO: 110 - protein, 39 aa, Artificial Sequence
  Description of Artificial Sequence: Synthetic polypeptide
  MOD_RES (2)..(2): Aib
HXEGTFTNDISKQYEKEAARQFIEWLKNGGPSSGAPPPS

SEQ ID NO: 111 - protein, 39 aa, Artificial Sequence
  Description of Artificial Sequence: Synthetic polypeptide
  MOD_RES (2)..(2): Aib
HXEGTFTSDISKQYEKEAARKFISWLKNGGPSSGAPPPS

SEQ ID NO: 112 - protein, 39 aa, Artificial Sequence
  Description of Artificial Sequence: Synthetic polypeptide
  MOD_RES (2)..(2): Aib
HXEGTFTNDISKQYEKEAARKFISWLKNGGPSSGAPPPS

SEQ ID NO: 113 - protein, 39 aa, Artificial Sequence
  Description of Artificial Sequence: Synthetic polypeptide
  MOD_RES (2)..(2): Aib
HXEGTFTNDLSKQYEKEAARKFISWLKNGGPSSGAPPPS

SEQ ID NO: 114 - protein, 39 aa, Artificial Sequence
  Description of Artificial Sequence: Synthetic polypeptide
  MOD_RES (2)..(2): Aib
HXEGTFTNDVSKQYEKEAARKFISWLKNGGPSSGAPPPS

SEQ ID NO: 115 - protein, 39 aa, Artificial Sequence
  Description of Artificial Sequence: Synthetic polypeptide
  MOD_RES (2)..(2): Aib
HXEGTFTSDVSKQYEKEAARKFISWLKNGGPSSGAPPPS

SEQ ID NO: 116 - protein, 39 aa, Artificial Sequence
  Description of Artificial Sequence: Synthetic polypeptide
  MOD_RES (2)..(2): Aib
HXEGTFTNDISKQYEKEYAREFISWLKNGGPSSGAPPPS

SEQ ID NO: 117 - protein, 39 aa, Artificial Sequence; identical to SEQ ID NO: 77
  Description of Artificial Sequence: Synthetic polypeptide
  MOD_RES (2)..(2): Aib

SEQ ID NO: 118 - protein, 39 aa, Artificial Sequence; identical to SEQ ID NO: 98
  Description of Artificial Sequence: Synthetic polypeptide
  MOD_RES (2)..(2): Aib

SEQ ID NO: 119 - protein, 39 aa, Artificial Sequence
  Description of Artificial Sequence: Synthetic polypeptide
  MOD_RES (2)..(2): Aib
HXEGTFTSDLSKQYEKEAAREFISWLKKGGPSSGAPPPS

SEQ ID NO: 120 - protein, 39 aa, Artificial Sequence
  Description of Artificial Sequence: Synthetic polypeptide
  MOD_RES (2)..(2): Aib
HXEGTFTSDLSKQYEKEAAKKFIEWLKNGGPSSGAPPPS

SEQ ID NO: 121 - protein, 39 aa, Artificial Sequence
  Description of Artificial Sequence: Synthetic polypeptide
  MOD_RES (2)..(2): Aib
HXEGTFTSDLSKQYEKEAAEEFIKWLKNGGPSSGAPPPS

SEQ ID NO: 122 - protein, 39 aa, Artificial Sequence
  Description of Artificial Sequence: Synthetic polypeptide
  MOD_RES (2)..(2): Aib
HXEGTFTSDLSKQMEEEAVRKFISWLKNGGPSSGAPPPS

SEQ ID NO: 123 - protein, 39 aa, Artificial Sequence
  Description of Artificial Sequence: Synthetic polypeptide
  MOD_RES (2)..(2): Aib
HXEGTFTSDLSKQYEEEAVKEFISWLKNGGPSSGAPPPS

SEQ ID NO: 124 - protein, 39 aa, Artificial Sequence
  Description of Artificial Sequence: Synthetic polypeptide
  MOD_RES (2)..(2): Aib
HXEGTFTSDLSKQMEEEAVKEFISWLKNGGPSSGAPPPS

SEQ ID NO: 125 - protein, 39 aa, Artificial Sequence
  Description of Artificial Sequence: Synthetic polypeptide
  MOD_RES (2)..(2): Aib
HXEGTFTSDLSKQMEEEAKREFISWLKNGGPSSGAPPPS

SEQ ID NO: 126 - protein, 39 aa, Artificial Sequence; identical to SEQ ID NO: 123
  Description of Artificial Sequence: Synthetic polypeptide
  MOD_RES (2)..(2): Aib

SEQ ID NO: 127 - protein, 39 aa, Artificial Sequence
  Description of Artificial Sequence: Synthetic polypeptide
  MOD_RES (2)..(2): Aib
HXEGTFTSDLSKQYEEEAAKKFISWLKNGGPSSGAPPPS

SEQ ID NO: 128 - protein, 39 aa, Artificial Sequence
  Description of Artificial Sequence: Synthetic polypeptide
  MOD_RES (2)..(2): Aib
HXEGTFTSDLSKQYEEKYAKEFISWLKNGGPSSGAPPPS

SEQ ID NO: 129 - protein, 39 aa, Artificial Sequence
  Description of Artificial Sequence: Synthetic polypeptide
  MOD_RES (2)..(2): Aib
HXEGTFTSDLSKQYEEKYKKEFISWLKNGGPSSGAPPPS

SEQ ID NO: 130 - protein, 39 aa, Artificial Sequence
  Description of Artificial Sequence: Synthetic polypeptide
  MOD_RES (2)..(2): Aib
HXEGTFTSDLSKQYEEEAVKEFISWLKQGGPSSGAPPPS

SEQ ID NO: 131 - protein, 39 aa, Artificial Sequence
  Description of Artificial Sequence: Synthetic polypeptide
  MOD_RES (2)..(2): Aib
HXEGTFTSDLSKQYEEEAAKKFISWLKQGGPSSGAPPPS

SEQ ID NO: 132 - protein, 39 aa, Artificial Sequence
  Description of Artificial Sequence: Synthetic polypeptide
  MOD_RES (2)..(2): Aib
HXEGTFTSDVSKQYEKEAVRKFISWLKNGGPSSGAPPPS

SEQ ID NO: 133 - protein, 39 aa, Artificial Sequence
  Description of Artificial Sequence: Synthetic polypeptide
  MOD_RES (2)..(2): Aib
HXEGTFTSDISKQYEKEAVREFISWLKNGGPSSGAPPPS

SEQ ID NO: 134 - protein, 39 aa, Artificial Sequence
  Description of Artificial Sequence: Synthetic polypeptide
  MOD_RES (2)..(2): Aib
HXEGTFTSDISKQYEKEAVRKFISWLKNGGPSSGAPPPS

SEQ ID NO: 135 - protein, 39 aa, Artificial Sequence
  Description of Artificial Sequence: Synthetic polypeptide
  MOD_RES (2)..(2): Aib
HXEGTFTSDVSKQYEKEAVKKFIEWLKNGGPSSGAPPPS

SEQ ID NO: 136 - protein, 39 aa, Artificial Sequence
  Description of Artificial Sequence: Synthetic polypeptide
  MOD_RES (2)..(2): Aib
HXEGTFTSDISKQYEKEAVKEFIEWLKNGGPSSGAPPPS

SEQ ID NO: 137 - protein, 39 aa, Artificial Sequence
  Description of Artificial Sequence: Synthetic polypeptide
  MOD_RES (2)..(2): Aib
HXEGTFTSDVSKQYEKEAAKKFIEWLKNGGPSSGAPPPS

SEQ ID NO: 138 - protein, 39 aa, Artificial Sequence
  Description of Artificial Sequence: Synthetic polypeptide
  MOD_RES (2)..(2): Aib
HXEGTFTSDVSKQYEKEAAKKFIEWLKQGGPSSGAPPPS

SEQ ID NO: 139 - protein, 39 aa, Artificial Sequence
  Description of Artificial Sequence: Synthetic polypeptide
  MOD_RES (2)..(2): Aib
HXEGTFTSDVSKQYEKEAARKFISWLKQGGPSSGAPPPS

SEQ ID NO: 140 - protein, 39 aa, Artificial Sequence
  Description of Artificial Sequence: Synthetic polypeptide
  MOD_RES (2)..(2): Aib
HXEGTFTSDVSKQYEKEAVKKFIEWLKQGGPSSGAPPPS

SEQ ID NO: 141 - protein, 39 aa, Artificial Sequence
  Description of Artificial Sequence: Synthetic polypeptide
  MOD_RES (2)..(2): Aib
HXEGTFTSDVSKQYEKKAAREFISWLKNGGPSSGAPPPS

SEQ ID NO: 142 - protein, 39 aa, Artificial Sequence
  Description of Artificial Sequence: Synthetic polypeptide
  MOD_RES (2)..(2): Aib
HXEGTFTSDLSKQYEKEAVRKFIEWLKNGGPSSGAPPPS

SEQ ID NO: 143 - protein, 39 aa, Artificial Sequence; identical to SEQ ID NO: 46
  Description of Artificial Sequence: Synthetic polypeptide
  MOD_RES (2)..(2): Aib

SEQ ID NO: 144 - protein, 39 aa, Artificial Sequence; identical to SEQ ID NO: 28
  Description of Artificial Sequence: Synthetic polypeptide

SEQ ID NO: 145 - protein, 39 aa, Artificial Sequence
  Description of Artificial Sequence: Synthetic polypeptide
  MOD_RES (2)..(2): Aib
HXEGTFTSDLSKQYEKEAVRLFIEWLKNGGPHSGAPPPS

SEQ ID NO: 146 - protein, 39 aa, Artificial Sequence; identical to SEQ ID NO: 56
  Description of Artificial Sequence: Synthetic polypeptide
  MOD_RES (2)..(2): Aib

SEQ ID NO: 147 - protein, 39 aa, Artificial Sequence; identical to SEQ ID NO: 76
  Description of Artificial Sequence: Synthetic polypeptide
  MOD_RES (2)..(2): Aib

SEQ ID NO: 148 - protein, 39 aa, Artificial Sequence
  Description of Artificial Sequence: Synthetic polypeptide
  MOD_RES (2)..(2): Aib
HXEGTFTSDLSKQYEKEAARKFIEWLKNGGPSSGAPPPS

SEQ ID NO: 149 - protein, 39 aa, Artificial Sequence; identical to SEQ ID NO: 57
  Description of Artificial Sequence: Synthetic polypeptide
  MOD_RES (2)..(2): Aib

SEQ ID NO: 150 - protein, 39 aa, Artificial Sequence; identical to SEQ ID NO: 63
  Description of Artificial Sequence: Synthetic polypeptide
  MOD_RES (2)..(2): Aib

SEQ ID NO: 151 - protein, 39 aa, Artificial Sequence
  Description of Artificial Sequence: Synthetic polypeptide
  MOD_RES (2)..(2): Aib
HXEGTFTSDLSKQYEKEAVRKFIEWLKNGGPHSGAPPPS

SEQ ID NO: 152 - protein, 39 aa, Artificial Sequence
  Description of Artificial Sequence: Synthetic polypeptide
  MOD_RES (2)..(2): Aib
HXEGTFTSDLSKQYEKEAVREFIEWLKNGGPHSGAPPPS

SEQ ID NO: 153 - protein, 39 aa, Artificial Sequence
  Description of Artificial Sequence: Synthetic polypeptide
  MOD_RES (2)..(2): Aib
HXEGTFTSDLSKQYEKEAVRQFIEWLKNGGPHSGAPPPS

SEQ ID NO: 154 - protein, 39 aa, Artificial Sequence
  Description of Artificial Sequence: Synthetic polypeptide
  MOD_RES (2)..(2): Aib
HXEGTFTSDLSKQYEKEAAREFIEWLKNGGPHSGAPPPS

SEQ ID NO: 155 - protein, 39 aa, Artificial Sequence
  Description of Artificial Sequence: Synthetic polypeptide
  MOD_RES (2)..(2): Aib
HXEGTFTSDLSKQYEKEAARQFIEWLKNGGPHSGAPPPS

SEQ ID NO: 156 - protein, 39 aa, Artificial Sequence
  Description of Artificial Sequence: Synthetic polypeptide
  MOD_RES (2)..(2): Aib
HXEGTFTSDLSKQYEKEAVRLFISWLKNGGPHSGAPPPS

SEQ ID NO: 157 - protein, 39 aa, Artificial Sequence
  Description of Artificial Sequence: Synthetic polypeptide
  MOD_RES (2)..(2): Aib
HXEGTFTSDLSKQYEKEAAREFISWLKNGGPSSGAPPPS

SEQ ID NO: 158 - protein, 39 aa, Artificial Sequence
  Description of Artificial Sequence: Synthetic polypeptide
  MOD_RES (2)..(2): Aib
HXEGTFTSDLSKQYEKEAVRKFISWLKNGGPSSGAPPPS

SEQ ID NO: 159 - protein, 39 aa, Artificial Sequence
  Description of Artificial Sequence: Synthetic polypeptide
  MOD_RES (2)..(2): Aib
  MOD_RES (16)..(16): Dap
HXEGTFTSDLSEQYEXEAAREFIEWLKNGGPSSGAPPPS

SEQ ID NO: 160 - protein, 39 aa, Artificial Sequence
  Description of Artificial Sequence: Synthetic polypeptide
  MOD_RES (2)..(2): Aib
  MOD_RES (16)..(16): Dap
HXEGTFTSDLSEQYEXEAARLFIEWLKNGGPSSGAPPPS

SEQ ID NO: 161 - protein, 39 aa, Artificial Sequence
  Description of Artificial Sequence: Synthetic polypeptide
  MOD_RES (2)..(2): Aib
HXEGTFTSDLSEQYEKEAARLFIEWLKNGGPSSGAPPPS

SEQ ID NO: 162 - protein, 39 aa, Artificial Sequence
  Description of Artificial Sequence: Synthetic polypeptide
  MOD_RES (2)..(2): Aib
HXEGTFTEDLSKQYEKEAVRLFISWLKNGGPSSGAPPPS

SEQ ID NO: 163-199 - skipped (37 entries)

SEQ ID NO: 200 - protein, 39 aa, Artificial Sequence
  Description of Artificial Sequence: Synthetic polypeptide
  MOD_RES (2)..(2): A, 2-aminoisobutyric acid (Aib), or G
  MOD_RES (3)..(3): E or N-methyl Glu
  MOD_RES (6)..(6): F or Y
  MOD_RES (7)..(7): S or T
  MOD_RES (8)..(8): diaminopimelic acid (Dap), E, K, N, N-methyl Ser, Q, S, s, or Y
  MOD_RES (9)..(9): D or E
  MOD_RES (10)..(10): I, L, N-methyl Leu, or V
  MOD_RES (12)..(12): E, K, Q, or S
  MOD_RES (13)..(13): Aib, E, K, Q, S, W, or Y
  MOD_RES (14)..(14): E, R, I, K, L, M, Q, or Y
  MOD_RES (16)..(16): 2,4-diaminobutanoic acid (Dab), Dap, E, K, k, or ornithine (Orn)
  MOD_RES (17)..(17): E, K, or Q
  MOD_RES (18)..(18): A, K, S, or Y
  MOD_RES (19)..(19): A, K, or V
  MOD_RES (20)..(20): E, K, or R
  MOD_RES (21)..(21): Aib, E, H, K, L, Q, or Y
  MOD_RES (24)..(24): A, Aib, E, K, Q, S, or Y
  MOD_RES (28)..(28): D, E, K, N, Q, S, or Y
  MOD_RES (32)..(32): Dap, H, K, R, or S
  See specification as filed for detailed description of substitutions and preferred embodiments
HXXGTXXXXXSXXXEXXXXXXFIXWLKXGGPXSGAPPPS

SEQ ID NO: 201 - protein, 39 aa, Artificial Sequence
  Description of Artificial Sequence: Synthetic polypeptide
  MOD_RES (2)..(2): A, 2-aminoisobutyric acid (Aib), or G
  MOD_RES (3)..(3): E or N-methyl Glu
  MOD_RES (6)..(6): F or Y
  MOD_RES (7)..(7): S or T
  MOD_RES (8)..(8): diaminopimelic acid (Dap), E, K, N, N-methyl Ser, Q, S, s, or Y
  MOD_RES (9)..(9): D or E
  MOD_RES (10)..(10): I, L, N-methyl Leu, or V
  MOD_RES (12)..(12): E, K, Q, or S
  MOD_RES (13)..(13): Aib, E, K, Q, S, W, or Y
  MOD_RES (16)..(16): K covalently bound to a lipophilic substituent, optionally via a spacer
  MOD_RES (17)..(17): E, K, or Q
  MOD_RES (18)..(18): A, K, S, or Y
  MOD_RES (19)..(19): A, K, or V
  MOD_RES (20)..(20): E, K, or R
  MOD_RES (21)..(21): Aib, E, H, K, L, Q, or Y
  MOD_RES (24)..(24): A, Aib, E, K, Q, S, or Y
  MOD_RES (28)..(28): D, E, K, N, Q, S, or Y
  MOD_RES (32)..(32): Dap, H, K, R, or S
  See specification as filed for detailed description of substitutions and preferred embodiments
HXXGTXXXXXSXXYEXXXXXXFIXWLKXGGPXSGAPPPS

SEQ ID NO: 202 - protein, 39 aa, Artificial Sequence
  Description of Artificial Sequence: Synthetic polypeptide
  MOD_RES (2)..(2): 2-aminoisobutyric acid (Aib) or G
  MOD_RES (8)..(8): N or S
  MOD_RES (9)..(9): D or E
  MOD_RES (10)..(10): I, L, or V
  MOD_RES (12)..(12): E or K
  MOD_RES (14)..(14): M or Y
  MOD_RES (16)..(16): Dap, E, or K
  MOD_RES (17)..(17): E or K
  MOD_RES (18)..(18): A or Y
  MOD_RES (19)..(19): A or V
  MOD_RES (20)..(20): E, K, or R
  MOD_RES (21)..(21): E, K, L, or Q
  MOD_RES (24)..(24): E, K, or S
  MOD_RES (28)..(28): E, K, N, or Q
  MOD_RES (32)..(32): H or S
  See specification as filed for detailed description of substitutions and preferred embodiments
HXEGTFTXXXSXQXEXXXXXXFIXWLKXGGPXSGAPPPS

SEQ ID NO: 203 - protein, 39 aa, Artificial Sequence
  Description of Artificial Sequence: Synthetic polypeptide
  MOD_RES (2)..(2): 2-aminoisobutyric acid (Aib) or G
  MOD_RES (8)..(8): N or S
  MOD_RES (9)..(9): D or E
  MOD_RES (10)..(10): I, L, or V
  MOD_RES (12)..(12): E or K
  MOD_RES (16)..(16): K covalently bound to a lipophilic substituent, optionally via a spacer
  MOD_RES (17)..(17): E or K
  MOD_RES (18)..(18): A or Y
  MOD_RES (19)..(19): A or V
  MOD_RES (20)..(20): E, K, or R
  MOD_RES (21)..(21): E, K, L, or Q
  MOD_RES (24)..(24): E, K, or S
  MOD_RES (28)..(28): E, K, N, or Q
  MOD_RES (32)..(32): H or S
  See specification as filed for detailed description of substitutions and preferred embodiments
HXEGTFTXXXSXQYEXXXXXXFIXWLKXGGPXSGAPPPS

SEQ ID NO: 204 - protein, 39 aa, Artificial Sequence
  Description of Artificial Sequence: Synthetic polypeptide
  MOD_RES (2)..(2): 2-aminoisobutyric acid (Aib) or G
  MOD_RES (8)..(8): N or S
  MOD_RES (10)..(10): I, L, or V
  MOD_RES (12)..(12): E, K, or Q
  MOD_RES (14)..(14): M or Y
  MOD_RES (16)..(16): (diaminopimelic acid) Dap covalently bound to a lipophilic substituent, optionally via a spacer, or K covalently bound to a lipophilic substituent, optionally via a spacer
  MOD_RES (17)..(17): E or K
  MOD_RES (18)..(18): A or Y
  MOD_RES (19)..(19): A or V
  MOD_RES (20)..(20): E, K, or R
  MOD_RES (21)..(21): E, K, L, or Q
  MOD_RES (24)..(24): E, K, or S
  MOD_RES (28)..(28): N or Q
  MOD_RES (32)..(32): H or S
  See specification as filed for detailed description of substitutions and preferred embodiments
HXEGTFTXDXSXQXEXXXXXXFIXWLKXGGPXSGAPPPS

SEQ ID NO: 205 - protein, 39 aa, Artificial Sequence
  Description of Artificial Sequence: Synthetic polypeptide
  MOD_RES (2)..(2): 2-aminoisobutyric acid (Aib) or G
  MOD_RES (8)..(8): N or S
  MOD_RES (10)..(10): I, L, or V
  MOD_RES (12)..(12): E, K, or Q
  MOD_RES (16)..(16): K covalently bound to a lipophilic substituent, optionally via a spacer
  MOD_RES (17)..(17): E or K
  MOD_RES (18)..(18): A or Y
  MOD_RES (19)..(19): A or V
  MOD_RES (20)..(20): E, K, or R
  MOD_RES (21)..(21): E, K, L, or Q
  MOD_RES (24)..(24): E, K, or S
  MOD_RES (28)..(28): N or Q
  MOD_RES (32)..(32): H or S
  See specification as filed for detailed description of substitutions and preferred embodiments
HXEGTFTXDXSXQYEXXXXXXFIXWLKXGGPXSGAPPPS

SEQ ID NO: 206 - protein, 39 aa, Artificial Sequence
  Description of Artificial Sequence: Synthetic polypeptide
  MOD_RES (2)..(2): 2-aminoisobutyric acid (Aib) or G
  MOD_RES (8)..(8): N or S
  MOD_RES (10)..(10): I, L, or V
  MOD_RES (14)..(14): M or Y
  MOD_RES (16)..(16): K covalently bound to a lipophilic substituent, optionally via a spacer
  MOD_RES (19)..(19): A or V
  MOD_RES (20)..(20): E, K, or R
  MOD_RES (21)..(21): E, K, L, or Q
  MOD_RES (24)..(24): E, K, or S
  MOD_RES (28)..(28): N or Q
  See specification as filed for detailed description of substitutions and preferred embodiments
HXEGTFTXDXSKQXEXEAXXXFIXWLKXGGPSSGAPPPS

SEQ ID NO: 207 - protein, 39 aa, Artificial Sequence
  Description of Artificial Sequence: Synthetic polypeptide
  MOD_RES (2)..(2): 2-aminoisobutyric acid (Aib) or G
  MOD_RES (8)..(8): N or S
  MOD_RES (10)..(10): I, L, or V
  MOD_RES (16)..(16): K covalently bound to a lipophilic substituent, optionally via a spacer
  MOD_RES (19)..(19): A or V
  MOD_RES (20)..(20): E, K, or R
  MOD_RES (21)..(21): E, K, L, or Q
  MOD_RES (24)..(24): E, K, or S
  MOD_RES (28)..(28): N or Q
  See specification as filed for detailed description of substitutions and preferred embodiments
HXEGTFTXDXSKQYEXEAXXXFIXWLKXGGPSSGAPPPS

SEQ ID NO: 208 - protein, 39 aa, Artificial Sequence
  Description of Artificial Sequence: Synthetic polypeptide
  MOD_RES (2)..(2): Aib
  MOD_RES (10)..(10): L or V
  MOD_RES (16)..(16): K covalently bound to a lipophilic substituent, optionally via a spacer
  MOD_RES (19)..(19): A or V
  MOD_RES (20)..(20): E, K, or R
  MOD_RES (21)..(21): K or Q
  MOD_RES (24)..(24): E, K, or S
  See specification as filed for detailed description of substitutions and preferred embodiments
HXEGTFTSDXSKQYEXEAXXXFIXWLKNGGPSSGAPPPS

SEQ ID NO: 209 - skipped

SEQ ID NO: 210 - protein, 39 aa, Artificial Sequence; identical to SEQ ID NO: 200
  Description of Artificial Sequence: Synthetic polypeptide
  MOD_RES (2)..(2): A, 2-aminoisobutyric acid (Aib), or G
  MOD_RES (3)..(3): E or N-methyl Glu
  MOD_RES (6)..(6): F or Y
  MOD_RES (7)..(7): S or T
  MOD_RES (8)..(8): diaminopimelic acid (Dap), E, K, N, N-methyl Ser, Q, S, s, or Y
  MOD_RES (9)..(9): D or E
  MOD_RES (10)..(10): I, L, N-methyl Leu, or V
  MOD_RES (12)..(12): E, K, Q, or S
  MOD_RES (13)..(13): Aib, E, K, Q, S, W, or Y
  MOD_RES (14)..(14): E, R, I, K, L, M, Q, or Y
  MOD_RES (16)..(16): 2,4-diaminobutanoic acid (Dab), Dap, E, K, k, or ornithine (Orn)
  MOD_RES (17)..(17): E, K, or Q
  MOD_RES (18)..(18): A, K, S, or Y
  MOD_RES (19)..(19): A, K, or V
  MOD_RES (20)..(20): E, K, or R
  MOD_RES (21)..(21): Aib, E, H, K, L, Q, or Y
  MOD_RES (24)..(24): A, Aib, E, K, Q, S, or Y
  MOD_RES (28)..(28): D, E, K, N, Q, S, or Y
  MOD_RES (32)..(32): Dap, H, K, R, or S
  See specification as filed for detailed description of substitutions and preferred embodiments

SEQ ID NO: 211-299 - skipped (89 entries)

SEQ ID NO: 300 - protein, 39 aa, Artificial Sequence
  Description of Artificial Sequence: Synthetic polypeptide
HGEGTFTSDLSKQMEEEAVRLFIEWLKNGGPSSGAPPPS

SEQ ID NO: 301 - protein, 30 aa, Artificial Sequence
  Description of Artificial Sequence: Synthetic polypeptide
HAEGTFTSDVSSYLEGQAAKEFIAWLVKGR

SEQ ID NO: 302-399 - skipped (98 entries)

SEQ ID NO: 400 - protein, 39 aa, Artificial Sequence; identical to SEQ ID NO: 200
  Description of Artificial Sequence: Synthetic polypeptide
  MOD_RES (2)..(2): A, 2-aminoisobutyric acid (Aib), or G
  MOD_RES (3)..(3): E or N-methyl Glu
  MOD_RES (6)..(6): F or Y
  MOD_RES (7)..(7): S or T
  MOD_RES (8)..(8): diaminopimelic acid (Dap), E, K, N, N-methyl Ser, Q, S, s, or Y
  MOD_RES (9)..(9): D or E
  MOD_RES (10)..(10): I, L, N-methyl Leu, or V
  MOD_RES (12)..(12): E, K, Q, or S
  MOD_RES (13)..(13): Aib, E, K, Q, S, W, or Y
  MOD_RES (14)..(14): E, R, I, K, L, M, Q, or Y
  MOD_RES (16)..(16): 2,4-diaminobutanoic acid (Dab), Dap, E, K, k, or ornithine (Orn)
  MOD_RES (17)..(17): E, K, or Q
  MOD_RES (18)..(18): A, K, S, or Y
  MOD_RES (19)..(19): A, K, or V
  MOD_RES (20)..(20): E, K, or R
  MOD_RES (21)..(21): Aib, E, H, K, L, Q, or Y
  MOD_RES (24)..(24): A, Aib, E, K, Q, S, or Y
  MOD_RES (28)..(28): D, E, K, N, Q, S, or Y
  MOD_RES (32)..(32): Dap, H, K, R, or S
  See specification as filed for detailed description of substitutions and preferred embodiments

SEQ ID NO: 401-404 - skipped (4 entries)

SEQ ID NO: 405 - protein, 39 aa, Artificial Sequence
  Description of Artificial Sequence: Synthetic polypeptide
  MOD_RES (2)..(2): 2-aminoisobutyric acid (Aib) or G
  MOD_RES (8)..(8): N or S
  MOD_RES (10)..(10): I, L, or V
  MOD_RES (12)..(12): E, K, or Q
  MOD_RES (17)..(17): E or K
  MOD_RES (18)..(18): A or Y
  MOD_RES (19)..(19): A or V
  MOD_RES (20)..(20): E, K, or R
  MOD_RES (21)..(21): E, K, L, or Q
  MOD_RES (24)..(24): E, K, or S
  MOD_RES (28)..(28): N or Q
  MOD_RES (32)..(32): H or S
  See specification as filed for detailed description of substitutions and preferred embodiments
HXEGTFTXDXSXQYEKXXXXXFIXWLKXGGPXSGAPPPS

SEQ ID NO: 406-1000 - skipped (595 entries)

SEQ ID NO: 1001 - protein, 39 aa, Artificial Sequence; identical to SEQ ID NO: 1
  Description of Artificial Sequence: Synthetic polypeptide

SEQ ID NO: 1002 - protein, 39 aa, Artificial Sequence; identical to SEQ ID NO: 2
  Description of Artificial Sequence: Synthetic polypeptide

SEQ ID NO: 1003 - protein, 39 aa, Artificial Sequence; identical to SEQ ID NO: 3
  Description of Artificial Sequence: Synthetic polypeptide

SEQ ID NO: 1004 - protein, 39 aa, Artificial Sequence; identical to SEQ ID NO: 4
  Description of Artificial Sequence: Synthetic polypeptide

SEQ ID NO: 1005 - protein, 39 aa, Artificial Sequence; identical to SEQ ID NO: 5
  Description of Artificial Sequence: Synthetic polypeptide

SEQ ID NO: 1006 - protein, 39 aa, Artificial Sequence; identical to SEQ ID NO: 6
  Description of Artificial Sequence: Synthetic polypeptide

SEQ ID NO: 1007-1012 - skipped (6 entries)

SEQ ID NO: 1013 - protein, 39 aa, Artificial Sequence; identical to SEQ ID NO: 13
  Description of Artificial Sequence: Synthetic polypeptide

SEQ ID NO: 1014 - protein, 39 aa, Artificial Sequence; identical to SEQ ID NO: 14
  Description of Artificial Sequence: Synthetic polypeptide

SEQ ID NO: 1015 - protein, 39 aa, Artificial Sequence; identical to SEQ ID NO: 15
  Description of Artificial Sequence: Synthetic polypeptide

SEQ ID NO: 1016 - protein, 39 aa, Artificial Sequence; identical to SEQ ID NO: 16
  Description of Artificial Sequence: Synthetic polypeptide

SEQ ID NO: 1017 - protein, 39 aa, Artificial Sequence; identical to SEQ ID NO: 17
  Description of Artificial Sequence: Synthetic polypeptide

SEQ ID NO: 1018 - protein, 39 aa, Artificial Sequence; identical to SEQ ID NO: 18
  Description of Artificial Sequence: Synthetic polypeptide

SEQ ID NO: 1019 - protein, 39 aa, Artificial Sequence; identical to SEQ ID NO: 19
  Description of Artificial Sequence: Synthetic polypeptide

SEQ ID NO: 1020 - protein, 39 aa, Artificial Sequence; identical to SEQ ID NO: 20
  Description of Artificial Sequence: Synthetic polypeptide

SEQ ID NO: 1021 - skipped

SEQ ID NO: 1022 - protein, 39 aa, Artificial Sequence; identical to SEQ ID NO: 22
  Description of Artificial Sequence: Synthetic polypeptide
  MOD_RES (2)..(2): Aib

SEQ ID NO: 1023 - protein, 39 aa, Artificial Sequence; identical to SEQ ID NO: 21
  Description of Artificial Sequence: Synthetic polypeptide
  MOD_RES (3)..(3): n-methyl-E

SEQ ID NO: 1024 - protein, 39 aa, Artificial Sequence; identical to SEQ ID NO: 6
  Description of Artificial Sequence: Synthetic polypeptide

SEQ ID NO: 1025-1026 - skipped (2 entries)

SEQ ID NO: 1027 - protein, 39 aa, Artificial Sequence; identical to SEQ ID NO: 27
  Description of Artificial Sequence: Synthetic polypeptide

SEQ ID NO: 1028 - protein, 39 aa, Artificial Sequence; identical to SEQ ID NO: 28
  Description of Artificial Sequence: Synthetic polypeptide

SEQ ID NO: 1029 - protein, 39 aa, Artificial Sequence; identical to SEQ ID NO: 29
  Description of Artificial Sequence: Synthetic polypeptide

SEQ ID NO: 1030 - protein, 39 aa, Artificial Sequence; identical to SEQ ID NO: 30
  Description of Artificial Sequence: Synthetic polypeptide

SEQ ID NO: 1031 - protein, 39 aa, Artificial Sequence; identical to SEQ ID NO: 31
  Description of Artificial Sequence: Synthetic polypeptide

SEQ ID NO: 1032 - protein, 39 aa, Artificial Sequence; identical to SEQ ID NO: 32
  Description of Artificial Sequence: Synthetic polypeptide
  MOD_RES (24)..(24): Aib

SEQ ID NO: 1033 - protein, 39 aa, Artificial Sequence; identical to SEQ ID NO: 6
  Description of Artificial Sequence: Synthetic polypeptide

SEQ ID NO: 1034-1038 - skipped (5 entries)

SEQ ID NO: 1039 - protein, 39 aa, Artificial Sequence; identical to SEQ ID NO: 39
  Description of Artificial Sequence: Synthetic polypeptide

SEQ ID NO: 1040 - protein, 39 aa, Artificial Sequence; identical to SEQ ID NO: 40
  Description of Artificial Sequence: Synthetic polypeptide

SEQ ID NO: 1041 - protein, 39 aa, Artificial Sequence; identical to SEQ ID NO: 41
  Description of Artificial Sequence: Synthetic polypeptide

SEQ ID NO: 1042 - protein, 39 aa, Artificial Sequence; identical to SEQ ID NO: 42
  Description of Artificial Sequence: Synthetic polypeptide

SEQ ID NO: 1043 - protein, 39 aa, Artificial Sequence; identical to SEQ ID NO: 43
  Description of Artificial Sequence: Synthetic polypeptide
  MOD_RES (21)..(21): Aib

SEQ ID NO: 1044 - protein, 39 aa, Artificial Sequence; identical to SEQ ID NO: 44
  Description of Artificial Sequence: Synthetic polypeptide

SEQ ID NO: 1045 - protein, 39 aa, Artificial Sequence; identical to SEQ ID NO: 45
  Description of Artificial Sequence: Synthetic polypeptide
  MOD_RES (2)..(2): Aib

SEQ ID NO: 1046 - protein, 39 aa, Artificial Sequence; identical to SEQ ID NO: 46
  Description of Artificial Sequence: Synthetic polypeptide
  MOD_RES (2)..(2): Aib

SEQ ID NO: 1047 - protein, 39 aa, Artificial Sequence; identical to SEQ ID NO: 47
  Description of Artificial Sequence: Synthetic polypeptide

SEQ ID NO: 1048 - protein, 39 aa, Artificial Sequence; identical to SEQ ID NO: 48
  Description of Artificial Sequence: Synthetic polypeptide

SEQ ID NO: 1049 - protein, 39 aa, Artificial Sequence; identical to SEQ ID NO: 49
  Description of Artificial Sequence: Synthetic polypeptide

SEQ ID NO: 1050 - protein, 39 aa, Artificial Sequence; identical to SEQ ID NO: 50
  Description of Artificial Sequence: Synthetic polypeptide
  MOD_RES (32)..(32): Dap

SEQ ID NO: 1051 - protein, 39 aa, Artificial Sequence; identical to SEQ ID NO: 51
  Description of Artificial Sequence: Synthetic polypeptide

SEQ ID NO: 1052 - protein, 39 aa, Artificial Sequence; identical to SEQ ID NO: 52
  Description of Artificial Sequence: Synthetic polypeptide

SEQ ID NO: 1053 - protein, 39 aa, Artificial Sequence; identical to SEQ ID NO: 53
  Description of Artificial Sequence: Synthetic polypeptide

SEQ ID NO: 1054 - protein, 39 aa, Artificial Sequence; identical to SEQ ID NO: 54
  Description of Artificial Sequence: Synthetic polypeptide
  MOD_RES (2)..(2): Aib

SEQ ID NO: 1055 - protein, 39 aa, Artificial Sequence; identical to SEQ ID NO: 55
  Description of Artificial Sequence: Synthetic polypeptide
  MOD_RES (2)..(2): Aib

SEQ ID NO: 1056 - protein, 39 aa, Artificial Sequence; identical to SEQ ID NO: 56
  Description of Artificial Sequence: Synthetic polypeptide
  MOD_RES (2)..(2): Aib

SEQ ID NO: 1057 - protein, 39 aa, Artificial Sequence; identical to SEQ ID NO: 57
  Description of Artificial Sequence: Synthetic polypeptide
  MOD_RES (2)..(2): Aib

SEQ ID NO: 1058 - protein, 39 aa, Artificial Sequence; identical to SEQ ID NO: 58
  Description of Artificial Sequence: Synthetic polypeptide
  MOD_RES (2)..(2): Aib

SEQ ID NO: 1059 - protein, 39 aa, Artificial Sequence; identical to SEQ ID NO: 59
  Description of Artificial Sequence: Synthetic polypeptide
  MOD_RES (2)..(2): Aib

SEQ ID NO: 1060 - protein, 39 aa, Artificial Sequence; identical to SEQ ID NO: 60
  Description of Artificial Sequence: Synthetic polypeptide
  MOD_RES (2)..(2): Aib

SEQ ID NO: 1061 - protein, 39 aa, Artificial Sequence; identical to SEQ ID NO: 61
  Description of Artificial Sequence: Synthetic polypeptide
  MOD_RES (2)..(2): Aib

SEQ ID NO: 1062 - protein, 39 aa, Artificial Sequence; identical to SEQ ID NO: 62
  Description of Artificial Sequence: Synthetic polypeptide
  MOD_RES (2)..(2): Aib

SEQ ID NO: 1063 - protein, 39 aa, Artificial Sequence; identical to SEQ ID NO: 63
  Description of Artificial Sequence: Synthetic polypeptide
  MOD_RES (2)..(2): Aib

SEQ ID NO: 1064 - protein, 39 aa, Artificial Sequence; identical to SEQ ID NO: 64
  Description of Artificial Sequence: Synthetic polypeptide
  MOD_RES (2)..(2): Aib

SEQ ID NO: 1065 - protein, 39 aa, Artificial Sequence; identical to SEQ ID NO: 65
  Description of Artificial Sequence: Synthetic polypeptide
  MOD_RES (2)..(2): Aib

SEQ ID NO: 1066 - protein, 39 aa, Artificial Sequence; identical to SEQ ID NO: 66
  Description of Artificial Sequence: Synthetic polypeptide
  MOD_RES (2)..(2): Aib
  MOD_RES (32)..(32): Dap

SEQ ID NO: 1067 - protein, 39 aa, Artificial Sequence; identical to SEQ ID NO: 67
  Description of Artificial Sequence: Synthetic polypeptide
  MOD_RES (2)..(2): Aib

SEQ ID NO: 1068 - protein, 39 aa, Artificial Sequence; identical to SEQ ID NO: 68
  Description of Artificial Sequence: Synthetic polypeptide
  MOD_RES (2)..(2): Aib

SEQ ID NO: 1069 - protein, 39 aa, Artificial Sequence; identical to SEQ ID NO: 69
  Description of Artificial Sequence: Synthetic polypeptide
  MOD_RES (2)..(2): Aib

SEQ ID NO: 1070 - protein, 39 aa, Artificial Sequence; identical to SEQ ID NO: 70
  Description of Artificial Sequence: Synthetic polypeptide
  MOD_RES (2)..(2): Aib

SEQ ID NO: 1071 - protein, 39 aa, Artificial Sequence; identical to SEQ ID NO: 71
  Description of Artificial Sequence: Synthetic polypeptide
  MOD_RES (2)..(2): Aib
  MOD_RES (16)..(16): Dap

SEQ ID NO: 1072 - protein, 39 aa, Artificial Sequence; identical to SEQ ID NO: 71
  Description of Artificial Sequence: Synthetic polypeptide
  MOD_RES (2)..(2): Aib
  MOD_RES (16)..(16): Dab

SEQ ID NO: 1073 - protein, 39 aa, Artificial Sequence; identical to SEQ ID NO: 71
  Description of Artificial Sequence: Synthetic polypeptide
  MOD_RES (2)..(2): Aib
  MOD_RES (16)..(16): Orn

SEQ ID NO: 1074 - protein, 39 aa, Artificial Sequence; identical to SEQ ID NO: 74
  Description of Artificial Sequence: Synthetic polypeptide
  MOD_RES (2)..(2): Aib

SEQ ID NO: 1075 - protein, 39 aa, Artificial Sequence; identical to SEQ ID NO: 75
  Description of Artificial Sequence: Synthetic polypeptide
  MOD_RES (2)..(2): Aib

SEQ ID NO: 1076 - protein, 39 aa, Artificial Sequence; identical to SEQ ID NO: 76
  Description of Artificial Sequence: Synthetic polypeptide
  MOD_RES (2)..(2): Aib

SEQ ID NO: 1077 - protein, 39 aa, Artificial Sequence; identical to SEQ ID NO: 77
  Description of Artificial Sequence: Synthetic polypeptide
  MOD_RES (2)..(2): Aib

SEQ ID NO: 1078 - protein, 39 aa, Artificial Sequence; identical to SEQ ID NO: 78
  Description of Artificial Sequence: Synthetic polypeptide
  MOD_RES (2)..(2): Aib

SEQ ID NO: 1079 - protein, 39 aa, Artificial Sequence; identical to SEQ ID NO: 79
  Description of Artificial Sequence: Synthetic polypeptide
  MOD_RES (2)..(2): Aib

SEQ ID NO: 1080 - protein, 39 aa, Artificial Sequence; identical to SEQ ID NO: 80
  Description of Artificial Sequence: Synthetic polypeptide
  MOD_RES (2)..(2): Aib

SEQ ID NO: 1081 - protein, 39 aa, Artificial Sequence; identical to SEQ ID NO: 81
  Description of Artificial Sequence: Synthetic polypeptide
  MOD_RES (2)..(2): Aib

SEQ ID NO: 1082 - protein, 39 aa, Artificial Sequence; identical to SEQ ID NO: 82
  Description of Artificial Sequence: Synthetic polypeptide
  MOD_RES (2)..(2): Aib

SEQ ID NO: 1083 - protein, 39 aa, Artificial Sequence; identical to SEQ ID NO: 83
  Description of Artificial Sequence: Synthetic polypeptide
  MOD_RES (2)..(2): Aib

SEQ ID NO: 1084 - protein, 39 aa, Artificial Sequence; identical to SEQ ID NO: 84
  Description of Artificial Sequence: Synthetic polypeptide
  MOD_RES (2)..(2): Aib

SEQ ID NO: 1085 - protein, 39 aa, Artificial Sequence; identical to SEQ ID NO: 85
  Description of Artificial Sequence: Synthetic polypeptide
  MOD_RES (2)..(2): Aib

SEQ ID NO: 1086 - protein, 39 aa, Artificial Sequence; identical to SEQ ID NO: 86
  Description of Artificial Sequence: Synthetic polypeptide
  MOD_RES (2)..(2): Aib

SEQ ID NO: 1087 - protein, 39 aa, Artificial Sequence; identical to SEQ ID NO: 87
  Description of Artificial Sequence: Synthetic polypeptide
  MOD_RES (2)..(2): Aib

SEQ ID NO: 1088 - protein, 39 aa, Artificial Sequence; identical to SEQ ID NO: 88
  Description of Artificial Sequence: Synthetic polypeptide
  MOD_RES (2)..(2): Aib

SEQ ID NO: 1089 - protein, 39 aa, Artificial Sequence; identical to SEQ ID NO: 89
  Description of Artificial Sequence: Synthetic polypeptide
  MOD_RES (2)..(2): Aib

SEQ ID NO: 1090 - protein, 39 aa, Artificial Sequence; identical to SEQ ID NO: 90
  Description of Artificial Sequence: Synthetic polypeptide
  MOD_RES (2)..(2): Aib

SEQ ID NO: 1091 - protein, 39 aa, Artificial Sequence; identical to SEQ ID NO: 91
  Description of Artificial Sequence: Synthetic polypeptide
  MOD_RES (2)..(2): Aib

SEQ ID NO: 1092 - protein, 39 aa, Artificial Sequence; identical to SEQ ID NO: 92
  Description of Artificial Sequence: Synthetic polypeptide
  MOD_RES (2)..(2): Aib

SEQ ID NO: 1093 - protein, 39 aa, Artificial Sequence; identical to SEQ ID NO: 93
  Description of Artificial Sequence: Synthetic polypeptide
  MOD_RES (2)..(2): Aib

SEQ ID NO: 1094 - protein, 39 aa, Artificial Sequence; identical to SEQ ID NO: 94
  Description of Artificial Sequence: Synthetic polypeptide
  MOD_RES (2)..(2): Aib

SEQ ID NO: 1095 - protein, 39 aa, Artificial Sequence; identical to SEQ ID NO: 95
  Description of Artificial Sequence: Synthetic polypeptide
  MOD_RES (2)..(2): Aib

SEQ ID NO: 1096 - protein, 39 aa, Artificial Sequence; identical to SEQ ID NO: 96
  Description of Artificial Sequence: Synthetic polypeptide
  MOD_RES (2)..(2): Aib

SEQ ID NO: 1097 - protein, 39 aa, Artificial Sequence; identical to SEQ ID NO: 97
  Description of Artificial Sequence: Synthetic polypeptide
  MOD_RES (2)..(2): Aib

SEQ ID NO: 1098 - protein, 39 aa, Artificial Sequence; identical to SEQ ID NO: 98
  Description of Artificial Sequence: Synthetic polypeptide
  MOD_RES (2)..(2): Aib

SEQ ID NO: 1099 - protein, 39 aa, Artificial Sequence; identical to SEQ ID NO: 99
  Description of Artificial Sequence: Synthetic polypeptide
  MOD_RES (2)..(2): Aib

SEQ ID NO: 1100 - protein, 39 aa, Artificial Sequence; identical to SEQ ID NO: 100
  Description of Artificial Sequence: Synthetic polypeptide
  MOD_RES (2)..(2): Aib

SEQ ID NO: 1101 - protein, 39 aa, Artificial Sequence; identical to SEQ ID NO: 101
  Description of Artificial Sequence: Synthetic polypeptide
  MOD_RES (2)..(2): Aib

SEQ ID NO: 1102 - protein, 39 aa, Artificial Sequence; identical to SEQ ID NO: 102
  Description of Artificial Sequence: Synthetic polypeptide
  MOD_RES (2)..(2): Aib

SEQ ID NO: 1103 - protein, 39 aa, Artificial Sequence; identical to SEQ ID NO: 103
  Description of Artificial Sequence: Synthetic polypeptide
  MOD_RES (2)..(2): Aib

SEQ ID NO: 1104 - protein, 39 aa, Artificial Sequence; identical to SEQ ID NO: 104
  Description of Artificial Sequence: Synthetic polypeptide
  MOD_RES (2)..(2): Aib

SEQ ID NO: 1105 - protein, 39 aa, Artificial Sequence; identical to SEQ ID NO: 105
  Description of Artificial Sequence: Synthetic polypeptide
  MOD_RES (2)..(2): Aib

SEQ ID NO: 1106 - protein, 39 aa, Artificial Sequence; identical to SEQ ID NO: 106
  Description of Artificial Sequence: Synthetic polypeptide
  MOD_RES (2)..(2): Aib

SEQ ID NO: 1107 - protein, 39 aa, Artificial Sequence; identical to SEQ ID NO: 107
  Description of Artificial Sequence: Synthetic polypeptide
  MOD_RES (2)..(2): Aib

SEQ ID NO: 1108 - protein, 39 aa, Artificial Sequence; identical to SEQ ID NO: 108
  Description of Artificial Sequence: Synthetic polypeptide
  MOD_RES (2)..(2): Aib

SEQ ID NO: 1109 - protein, 39 aa, Artificial Sequence; identical to SEQ ID NO: 109
  Description of Artificial Sequence: Synthetic polypeptide
  MOD_RES (2)..(2): Aib

SEQ ID NO: 1110 - protein, 39 aa, Artificial Sequence; identical to SEQ ID NO: 110
  Description of Artificial Sequence: Synthetic polypeptide
  MOD_RES (2)..(2): Aib

SEQ ID NO: 1111 - protein, 39 aa, Artificial Sequence; identical to SEQ ID NO: 111
  Description of Artificial Sequence: Synthetic polypeptide
  MOD_RES (2)..(2): Aib

SEQ ID NO: 1112 - protein, 39 aa, Artificial Sequence; identical to SEQ ID NO: 112
  Description of Artificial Sequence: Synthetic polypeptide
  MOD_RES (2)..(2): Aib

SEQ ID NO: 1113 - protein, 39 aa, Artificial Sequence; identical to SEQ ID NO: 113
  Description of Artificial Sequence: Synthetic polypeptide
  MOD_RES (2)..(2): Aib

SEQ ID NO: 1114 - protein, 39 aa, Artificial Sequence; identical to SEQ ID NO: 114
  Description of Artificial Sequence: Synthetic polypeptide
  MOD_RES (2)..(2): Aib

SEQ ID NO: 1115 - protein, 39 aa, Artificial Sequence; identical to SEQ ID NO: 115
  Description of Artificial Sequence: Synthetic polypeptide
  MOD_RES (2)..(2): Aib

SEQ ID NO: 1116 - protein, 39 aa, Artificial Sequence; identical to SEQ ID NO: 116
  Description of Artificial Sequence: Synthetic polypeptide
  MOD_RES (2)..(2): Aib

SEQ ID NO: 1117-1118 - skipped (2 entries)

SEQ ID NO: 1119 - protein, 39 aa, Artificial Sequence; identical to SEQ ID NO: 119
  Description of Artificial Sequence: Synthetic polypeptide
  MOD_RES (2)..(2): Aib

SEQ ID NO: 1120 - protein, 39 aa, Artificial Sequence; identical to SEQ ID NO: 120
  Description of Artificial Sequence: Synthetic polypeptide
  MOD_RES (2)..(2): Aib

SEQ ID NO: 1121 - protein, 39 aa, Artificial Sequence; identical to SEQ ID NO: 121
  Description of Artificial Sequence: Synthetic polypeptide
  MOD_RES (2)..(2): Aib

SEQ ID NO: 1122 - protein, 39 aa, Artificial Sequence; identical to SEQ ID NO: 122
  Description of Artificial Sequence: Synthetic polypeptide
  MOD_RES (2)..(2): Aib

SEQ ID NO: 1123 - protein, 39 aa, Artificial Sequence; identical to SEQ ID NO: 123
  Description of Artificial Sequence: Synthetic polypeptide
  MOD_RES (2)..(2): Aib

SEQ ID NO: 1124 - protein, 39 aa, Artificial Sequence; identical to SEQ ID NO: 124
  Description of Artificial Sequence: Synthetic polypeptide
  MOD_RES (2)..(2): Aib

SEQ ID NO: 1125 - protein, 39 aa, Artificial Sequence; identical to SEQ ID NO: 125
  Description of Artificial Sequence: Synthetic polypeptide
  MOD_RES (2)..(2): Aib

SEQ ID NO: 1126 - skipped

SEQ ID NO: 1127 - protein, 39 aa, Artificial Sequence; identical to SEQ ID NO: 127
  Description of Artificial Sequence: Synthetic polypeptide
  MOD_RES (2)..(2): Aib

SEQ ID NO: 1128 - protein, 39 aa, Artificial Sequence; identical to SEQ ID NO: 128
  Description of Artificial Sequence: Synthetic polypeptide
  MOD_RES (2)..(2): Aib

SEQ ID NO: 1129 - protein, 39 aa, Artificial Sequence; identical to SEQ ID NO: 129
  Description of Artificial Sequence: Synthetic polypeptide
  MOD_RES (2)..(2): Aib

SEQ ID NO: 1130 - protein, 39 aa, Artificial Sequence; identical to SEQ ID NO: 130
  Description of Artificial Sequence: Synthetic polypeptide
  MOD_RES (2)..(2): Aib

SEQ ID NO: 1131 - protein, 39 aa, Artificial Sequence; identical to SEQ ID NO: 131
  Description of Artificial Sequence: Synthetic polypeptide
  MOD_RES (2)..(2): Aib

SEQ ID NO: 1132 - protein, 39 aa, Artificial Sequence; identical to SEQ ID NO: 132
  Description of Artificial Sequence: Synthetic polypeptide
  MOD_RES (2)..(2): Aib

SEQ ID NO: 1133 - protein, 39 aa, Artificial Sequence; identical to SEQ ID NO: 133
  Description of Artificial Sequence: Synthetic polypeptide
  MOD_RES (2)..(2): Aib

SEQ ID NO: 1134 - protein, 39 aa, Artificial Sequence; identical to SEQ ID NO: 134
  Description of Artificial Sequence: Synthetic polypeptide
  MOD_RES (2)..(2): Aib

SEQ ID NO: 1135 - protein, 39 aa, Artificial Sequence; identical to SEQ ID NO: 135
  Description of Artificial Sequence: Synthetic polypeptide
  MOD_RES (2)..(2): Aib

SEQ ID NO: 1136 - protein, 39 aa, Artificial Sequence; identical to SEQ ID NO: 136
  Description of Artificial Sequence: Synthetic polypeptide
  MOD_RES (2)..(2): Aib

SEQ ID NO: 1137 - protein, 39 aa, Artificial Sequence; identical to SEQ ID NO: 137
  Description of Artificial Sequence: Synthetic polypeptide
  MOD_RES (2)..(2): Aib

SEQ ID NO: 1138 - protein, 39 aa, Artificial Sequence; identical to SEQ ID NO: 138
  Description of Artificial Sequence: Synthetic polypeptide
  MOD_RES (2)..(2): Aib

SEQ ID NO: 1139 - protein, 39 aa, Artificial Sequence; identical to SEQ ID NO: 139
  Description of Artificial Sequence: Synthetic polypeptide
  MOD_RES (2)..(2): Aib

SEQ ID NO: 1140 - protein, 39 aa, Artificial Sequence; identical to SEQ ID NO: 140
  Description of Artificial Sequence: Synthetic polypeptide
  MOD_RES (2)..(2): Aib

SEQ ID NO: 1141 - protein, 39 aa, Artificial Sequence; identical to SEQ ID NO: 141
  Description of Artificial Sequence: Synthetic polypeptide
  MOD_RES (2)..(2): Aib

SEQ ID NO: 1142 - protein, 39 aa, Artificial Sequence; identical to SEQ ID NO: 142
  Description of Artificial Sequence: Synthetic polypeptide
  MOD_RES (2)..(2): Aib

SEQ ID NO: 1143-1144 - skipped (2 entries)

SEQ ID NO: 1145 - protein, 39 aa, Artificial Sequence; identical to SEQ ID NO: 145
  Description of Artificial Sequence: Synthetic polypeptide
  MOD_RES (2)..(2): Aib

SEQ ID NO: 1146-1147 - skipped (2 entries)

SEQ ID NO: 1148 - protein, 39 aa, Artificial Sequence; identical to SEQ ID NO: 148
  Description of Artificial Sequence: Synthetic polypeptide
  MOD_RES (2)..(2): Aib

SEQ ID NO: 1149-1150 - skipped (2 entries)

SEQ ID NO: 1151 - protein, 39 aa, Artificial Sequence; identical to SEQ ID NO: 151
  Description of Artificial Sequence: Synthetic polypeptide
  MOD_RES (2)..(2): Aib

SEQ ID NO: 1152 - protein, 39 aa, Artificial Sequence; identical to SEQ ID NO: 152
  Description of Artificial Sequence: Synthetic polypeptide
  MOD_RES (2)..(2): Aib

SEQ ID NO: 1153 - protein, 39 aa, Artificial Sequence; identical to SEQ ID NO: 153
  Description of Artificial Sequence: Synthetic polypeptide
  MOD_RES (2)..(2): Aib

SEQ ID NO: 1154 - protein, 39 aa, Artificial Sequence; identical to SEQ ID NO: 154
  Description of Artificial Sequence: Synthetic polypeptide
  MOD_RES (2)..(2): Aib

SEQ ID NO: 1155 - protein, 39 aa, Artificial Sequence; identical to SEQ ID NO: 155
  Description of Artificial Sequence: Synthetic polypeptide
  MOD_RES (2)..(2): Aib

SEQ ID NO: 1156 - protein, 39 aa, Artificial Sequence; identical to SEQ ID NO: 156
  Description of Artificial Sequence: Synthetic polypeptide
  MOD_RES (2)..(2): Aib

SEQ ID NO: 1157 - protein, 39 aa, Artificial Sequence; identical to SEQ ID NO: 157
  Description of Artificial Sequence: Synthetic polypeptide
  MOD_RES (2)..(2): Aib

SEQ ID NO: 1158 - protein, 39 aa, Artificial Sequence; identical to SEQ ID NO: 158
  Description of Artificial Sequence: Synthetic polypeptide
  MOD_RES (2)..(2): Aib

SEQ ID NO: 1159 - protein, 39 aa, Artificial Sequence; identical to SEQ ID NO: 159
  Description of Artificial Sequence: Synthetic polypeptide
  MOD_RES (2)..(2): Aib
  MOD_RES (16)..(16): Dap

SEQ ID NO: 1160 - protein, 39 aa, Artificial Sequence; identical to SEQ ID NO: 160
  Description of Artificial Sequence: Synthetic polypeptide
  MOD_RES (2)..(2): Aib
  MOD_RES (16)..(16): Dap

SEQ ID NO: 1161 - protein, 39 aa, Artificial Sequence; identical to SEQ ID NO: 161
  Description of Artificial Sequence: Synthetic polypeptide
  MOD_RES (2)..(2): Aib

SEQ ID NO: 1162 - protein, 39 aa, Artificial Sequence; identical to SEQ ID NO: 162
  Description of Artificial Sequence: Synthetic polypeptide
  MOD_RES (2)..(2): Aib

SEQ ID NO: 1163-2116 - skipped (954 entries)

SEQ ID NO: 2117 - protein, 39 aa, Artificial Sequence; identical to SEQ ID NO: 77
  Description of Artificial Sequence: Synthetic polypeptide
  MOD_RES (2)..(2): Aib

SEQ ID NO: 2118 - protein, 39 aa, Artificial Sequence; identical to SEQ ID NO: 98
  Description of Artificial Sequence: Synthetic polypeptide
  MOD_RES (2)..(2): Aib

SEQ ID NO: 2119 - protein, 39 aa, Artificial Sequence; identical to SEQ ID NO: 119
  Description of Artificial Sequence: Synthetic polypeptide
  MOD_RES (2)..(2): Aib

SEQ ID NO: 2120 - protein, 39 aa, Artificial Sequence; identical to SEQ ID NO: 120
  Description of Artificial Sequence: Synthetic polypeptide
  MOD_RES (2)..(2): Aib

SEQ ID NO: 2121 - protein, 39 aa, Artificial Sequence; identical to SEQ ID NO: 121
  Description of Artificial Sequence: Synthetic polypeptide
  MOD_RES (2)..(2): Aib

SEQ ID NO: 2122-2134 - skipped (13 entries)

SEQ ID NO: 2135 - protein, 39 aa, Artificial Sequence; identical to SEQ ID NO: 135
  Description of Artificial Sequence: Synthetic polypeptide
  MOD_RES (2)..(2): Aib

SEQ ID NO: 2136 - protein, 39 aa, Artificial Sequence; identical to SEQ ID NO: 136
  Description of Artificial Sequence: Synthetic polypeptide
  MOD_RES (2)..(2): Aib

SEQ ID NO: 2137 - protein, 39 aa, Artificial Sequence; identical to SEQ ID NO: 137
  Description of Artificial Sequence: Synthetic polypeptide
  MOD_RES (2)..(2): Aib

SEQ ID NO: 2138 - protein, 39 aa, Artificial Sequence; identical to SEQ ID NO: 138
  Description of Artificial Sequence: Synthetic polypeptide
  MOD_RES (2)..(2): Aib

SEQ ID NO: 2139 - skipped

SEQ ID NO: 2140 - protein, 39 aa, Artificial Sequence; identical to SEQ ID NO: 140
  Description of Artificial Sequence: Synthetic polypeptide
  MOD_RES (2)..(2): Aib

SEQ ID NO: 2141 - protein, 39 aa, Artificial Sequence; identical to SEQ ID NO: 141
  Description of Artificial Sequence: Synthetic polypeptide
  MOD_RES (2)..(2): Aib

SEQ ID NO: 2142-3114 - skipped (973 entries)

SEQ ID NO: 3115 - protein, 39 aa, Artificial Sequence; identical to SEQ ID NO: 115
  Description of Artificial Sequence: Synthetic polypeptide
  MOD_RES (2)..(2): Aib

SEQ ID NO: 3116-3119 - skipped (4 entries)

SEQ ID NO: 3120 - protein, 39 aa, Artificial Sequence; identical to SEQ ID NO: 120
  Description of Artificial Sequence: Synthetic polypeptide
  MOD_RES (2)..(2): Aib

SEQ ID NO: 3121-4114 - skipped (994 entries)

SEQ ID NO: 4115 - protein, 39 aa, Artificial Sequence; identical to SEQ ID NO: 115
  Description of Artificial Sequence: Synthetic polypeptide
  MOD_RES (2)..(2): Aib

SEQ ID NO: 4116-4119 - skipped (4 entries)

SEQ ID NO: 4120 - protein, 39 aa, Artificial Sequence; identical to SEQ ID NO: 120
  Description of Artificial Sequence: Synthetic polypeptide
  MOD_RES (2)..(2): Aib

SEQ ID NO: 4121-5114 - skipped (994 entries)

SEQ ID NO: 5115 - protein, 39 aa, Artificial Sequence; identical to SEQ ID NO: 115
  Description of Artificial Sequence: Synthetic polypeptide
  MOD_RES (2)..(2): Aib

SEQ ID NO: 5116-5119 - skipped (4 entries)

SEQ ID NO: 5120 - protein, 39 aa, Artificial Sequence; identical to SEQ ID NO: 120
  Description of Artificial Sequence: Synthetic polypeptide
  MOD_RES (2)..(2): Aib

SEQ ID NO: 5121-6114 - skipped (994 entries)

SEQ ID NO: 6115 - protein, 39 aa, Artificial Sequence; identical to SEQ ID NO: 115
  Description of Artificial Sequence: Synthetic polypeptide
  MOD_RES (2)..(2): Aib
  MOD_RES (16)..(16): K(free amine)

SEQ ID NO: 6116-6119 - skipped (4 entries)

SEQ ID NO: 6120 - protein, 39 aa, Artificial Sequence; identical to SEQ ID NO: 120
  Description of Artificial Sequence: Synthetic polypeptide
  MOD_RES (2)..(2): Aib
  MOD_RES (16)..(16): K(free amine)

SEQ ID NO: 6121-7114 - skipped (994 entries)

SEQ ID NO: 7115 - protein, 39 aa, Artificial Sequence; identical to SEQ ID NO: 115
  Description of Artificial Sequence: Synthetic polypeptide
  MOD_RES (2)..(2): Aib
  MOD_RES (16)..(16): K(Alloc)

SEQ ID NO: 7116-7119 - skipped (4 entries)

SEQ ID NO: 7120 - protein, 39 aa, Artificial Sequence; identical to SEQ ID NO: 120
  Description of Artificial Sequence: Synthetic polypeptide
  MOD_RES (2)..(2): Aib
  MOD_RES (16)..(16): K(ivDde)

SEQ ID NO: 7121-8119 - skipped (999 entries)

SEQ ID NO: 8120 - protein, 39 aa, Artificial Sequence; identical to SEQ ID NO: 120
  Description of Artificial Sequence: Synthetic polypeptide
  MOD_RES (2)..(2): Aib
  MOD_RES (16)..(16): K(ivDde)

SEQ ID NO: 8121-9119 - skipped (999 entries)

SEQ ID NO: 9120 - protein, 39 aa, Artificial Sequence; identical to SEQ ID NO: 120
  Description of Artificial Sequence: Synthetic polypeptide
  MOD_RES (2)..(2): Aib
  MOD_RES (16)..(16): K(ivDde)
  MOD_RES (20)..(20): K(Alloc)
  MOD_RES (24)..(24): E(Allyl)

SEQ ID NO: 9121 - protein, 4 aa, Artificial Sequence
  Description of Artificial Sequence: Synthetic peptide
EEEE

SEQ ID NO: 9122 - protein, 10 aa, Artificial Sequence
  Description of Artificial Sequence: Synthetic peptide
  MOD_RES (1)..(10): Gamma-Glu
  SITE (1)..(10): This sequence may encompass 1-10 residues
EEEEEEEEEE

SEQ ID NO: 9123 - protein, 4 aa, Artificial Sequence
  Description of Artificial Sequence: Synthetic peptide
  MOD_RES (1)..(4): Gamma-Glu
EEEE

SEQ ID NO: 9124 - protein, 5 aa, Artificial Sequence
  Description of Artificial Sequence: Synthetic peptide
  MOD_RES (1)..(5): Gamma-Glu
EEEEE

SEQ ID NO: 9125 - protein, 4 aa, Artificial Sequence
  Description of Artificial Sequence: Synthetic peptide
  MOD_RES (1)..(3): Gamma-Glu
EEEG

SEQ ID NO: 9126 - protein, 11 aa, Artificial Sequence
  Description of Artificial Sequence: Synthetic peptide
  MOD_RES (2)..(11): Gamma-Glu
  SITE (2)..(11): This sequence may encompass 1-10 residues
GEEEEEEEEEE

SEQ ID NO: 9127 - protein, 11 aa, Artificial Sequence
  Description of Artificial Sequence: Synthetic peptide
  MOD_RES (1)..(10): Gamma-Glu
  SITE (1)..(10): This sequence may encompass 1-10 residues
EEEEEEEEEEG

SEQ ID NO: 9128 - protein, 7 aa, Artificial Sequence
  Description of Artificial Sequence: Synthetic peptide
AKAAREW

What is claimed is:

1. An isolated polypeptide, comprising the amino acid sequence $HX_2X_3GTX_6X_7X_8X_9X_{10}SX_{12}X_{13}X_{14}EX_{16}X_{17}X_{18}X_{19}X_{20}X_{21}FIX_{24}WLKX_{28}G GPX_{32}SGAPPPS$-(OH/N $H_2$) (SEQ ID NO: 200) or a pharmaceutically acceptable salt thereof, wherein:
   $X_2$ is A, 2-aminoisobutyric acid (Aib), or G;
   $X_3$ is E or N-methyl Glu;
   $X_6$ is F or Y;
   $X_7$ is S or T;
   $X_8$ is diaminopimelic acid (Dap), E, K, N, N-methyl Ser, Q, S, s, or Y;
   $X_9$ is D or E;
   $X_{10}$ is I, L, N-methyl Leu, or V;
   $X_{12}$ is E, K, Q, or S;
   $X_{13}$ is Aib, E, K, Q, S, W, or Y;
   $X_{14}$ is Y;
   $X_{16}$ is 2,4-diaminobutanoic acid (Dab), Dap, E, K, k, or ornithine (Orn);
   $X_{17}$ is E, K, or Q;
   $X_{18}$ is A, K, S, or Y;
   $X_{19}$ is A, K, or V;
   $X_{20}$ is E, K, or R;
   $X_{21}$ is Aib, E, H, K, L, Q, or Y;
   $X_{24}$ is A, Aib, E, K, Q, S, or Y;
   $X_{28}$ is D, E, K, N, Q, S, or Y; and
   $X_{32}$ is Dap, H, K, R, or S;
   wherein when $X_{16}$ is Dab, Dap, K, or Orn, it is covalently bound to a lipophilic substituent, optionally via a spacer;
   wherein when $X_{16}$ is E, at least one of $X_{17}$, $X_{18}$, $X_{19}$, $X_{20}$, or $X_{21}$ is K and covalently bound to a lipophilic substituent, optionally via a spacer; and
   wherein the peptide optionally further comprises a lactam bridge formed via an amide bond between the side chains of K and E at positions $X_{17}$ and $X_{21}$; at positions $X_{21}$ and $X_{17}$; at positions $X_{21}$ and $X_{28}$; at positions $X_{28}$ and $X_{21}$; at positions $X_{20}$ and $X_{24}$; at positions $X_{24}$ and $X_{20}$; or at positions $X_{12}$ and $X_{16}$.

2. The isolated polypeptide of claim 1, comprising the amino acid sequence: $HX_2EGTFTX_8DX_{10}SX_{12}QX_{14}EX_{16}X_{17}X_{18}X_{19}X_{20}X_{21}FIX_{24}WLKX_{28}G GPX_{32}SGAPPPS$-(OH/$NH_2$) (SEQ ID NO: 204), or a pharmaceutically acceptable salt thereof, wherein:
   $X_2$ is 2-aminoisobutyric acid (Aib) or G;
   $X_8$ is N or S;
   $X_{10}$ is I, L, or V;
   $X_{12}$ is E, K, or Q;
   $X_{14}$ is Y;
   $X_{16}$ is (Dap) covalently bound to a lipophilic substituent, optionally via a spacer, or K covalently bound to a lipophilic substituent, optionally via a spacer;
   $X_{17}$ is E or K;
   $X_{18}$ is A or Y;
   $X_{19}$ is A or V;
   $X_{20}$ is E, K, or R;
   $X_{21}$ is E, K, L, or Q;
   $X_{24}$ is E, K, or S;
   $X_{28}$ is N or Q; and
   $X_{32}$ is H or S;
   wherein the peptide optionally further comprises a lactam bridge formed via an amide bond between the side chains of K and E at positions $X_{17}$ and $X_{21}$; at positions $X_{21}$ and $X_{17}$; at positions $X_{20}$ and $X_{24}$; or at positions $X_{24}$ and $X_{20}$.

3. The isolated polypeptide of claim 1, comprising the amino acid sequence: $HAibEGTFTSDX_{10}SKQYEX_{16}EAX_{19}X_{20}X_{21}FIX_{24}WLKNGGPSSGAPPPS$-(OH/$NH_2$) (SEQ ID NO: 208), or a pharmaceutically acceptable salt thereof, wherein:
   $X_{10}$ is L or V;
   $X_{16}$ is K covalently bound to a lipophilic substituent, optionally via a spacer;
   $X_{19}$ is A or V;
   $X_{20}$ is E, K, or R;
   $X_{21}$ is K or Q;
   $X_{24}$ is E, K, or S; and
   wherein the peptide optionally further comprises a lactam bridge formed via an amide bond between the side chains of K and E at positions $X_{21}$ and $X_{17}$; at positions $X_{20}$ and $X_{24}$; or at positions $X_{24}$ and $X_{20}$.

4. The isolated polypeptide of claim 1, or a pharmaceutically acceptable salt thereof, wherein if $X_{16}$ is E, then $X_{21}$ is K or E.

5. The isolated polypeptide of claim 1, or a pharmaceutically acceptable salt thereof, wherein $X_{16}$ is K covalently bound to a lipophilic substituent, optionally via a spacer.

6. The isolated polypeptide of claim 1, or a pharmaceutically acceptable salt thereof, wherein if $X_{24}$ is S, then $X_{10}$ is V.

7. The isolated polypeptide of claim 1, or a pharmaceutically acceptable salt thereof, wherein the peptide further comprises a lactam bridge formed via an amide bond between the side chains of K and E at positions $X_{20}$ and $X_{24}$.

8. The isolated polypeptide of claim 1, or a pharmaceutically acceptable salt thereof, wherein $X_2$ is Aib.

9. The isolated polypeptide of claim 1, or a pharmaceutically acceptable salt thereof, wherein the lipophilic substituent is covalently bound to the isolated polypeptide via a spacer, and wherein the lipophilic substituent and spacer are of Formula II:

$$-(Y)_n-CO-(CH_2)_m-Z \qquad \text{Formula II}$$

or of Formula IV:

$$-(Y1)_{n1}-(dpeg)_r-(Y2)_{n2}-CO-(CH_2)_m-Z \qquad \text{Formula IV}$$

wherein,
  dpeg is —[CO(CH$_2$)O(CH$_2$)$_2$O(CH$_2$)NH]—;
  Y is selected from the group consisting of γGlu, D, K, and G;
  Y1 is selected from the group consisting of γGlu, D and G;
  Y2 is selected from the group consisting of γGlu, D and G;
  Z is —CH$_3$ or —CO$_2$H;
  m is from 4 to 24;
  n is from 1 to 10
  n1 is from 0 to 10;
  n2 is from 0 to 10; and
  r is from 1 to 8.

10. The isolated polypeptide of claim 1, or a pharmaceutically acceptable salt thereof, comprising the amino acid sequence of any one of SEQ ID NOs: 15, 27-32, 39-121, and 126-162.

11. The isolated polypeptide of claim 10, comprising the amino acid sequence of any one of SEQ ID NOs: 55, 115, 120, and 132, or a pharmaceutically acceptable salt thereof.

12. The isolated polypeptide of claim 11, comprising the amino acid sequence of SEQ ID NO: 115, or a pharmaceutically acceptable salt thereof.

13. The isolated polypeptide of claim 11, comprising the amino acid sequence of SEQ ID NO: 120, or a pharmaceutically acceptable salt thereof.

14. A pharmaceutical composition comprising the isolated polypeptide of claim 1, or a pharmaceutically acceptable salt thereof, and a pharmaceutically acceptable adjuvant, carrier, or vehicle.

15. An osmotic delivery device, comprising the isolated polypeptide of claim 1, or a pharmaceutically acceptable salt thereof.

16. A method of treating obesity, providing weight loss, or suppressing appetite in a human subject, comprising administering to the subject in need thereof a pharmaceutical composition comprising the isolated polypeptide of claim 1, or a pharmaceutically acceptable salt thereof.

17. The method of claim 16, wherein said pharmaceutical composition is administered via injection.

18. The method of claim 16, wherein said pharmaceutical composition is administered orally.

19. A method of treating diabetes in a human subject, comprising administering to the subject in need thereof a pharmaceutical composition comprising the isolated polypeptide of claim 1, or a pharmaceutically acceptable salt thereof.

20. The method of claim 19, wherein said pharmaceutical composition is administered via injection.

21. The method of claim 19, wherein said pharmaceutical composition is administered orally.

22. A method of treating nonalcoholic fatty liver disease (NAFLD) and/or nonalcoholic steatohepatitis (NASH) in a human subject, comprising administering to the subject in need thereof a pharmaceutical composition comprising the isolated polypeptide of claim 1, or a pharmaceutically acceptable salt thereof.

23. The method of claim 22, wherein said pharmaceutical composition is administered via injection.

24. The method of claim 22, wherein said pharmaceutical composition is administered orally.

25. The method of claim 16, wherein said isolated polypeptide comprises the amino acid sequence of SEQ ID NO: 115, or a pharmaceutically acceptable salt thereof.

26. The method of claim 19, wherein said isolated polypeptide comprises the amino acid sequence of SEQ ID NO: 115, or a pharmaceutically acceptable salt thereof.

27. The method of claim 16, wherein said isolated polypeptide comprises the amino acid sequence of SEQ ID NO: 120, or a pharmaceutically acceptable salt thereof.

28. The method of claim 19, wherein said isolated polypeptide comprises the amino acid sequence of SEQ ID NO: 120, or a pharmaceutically acceptable salt thereof.

* * * * *